United States Patent 9,719,064 (GENOMICS OF ACTINOPLANES UTAHENSIS) - sequence listing, part 10

SEQ ID NO: 16053 - DNA, 9087635 bp, Actinoplanes utahensis (residues 7,270,109-9,087,635 of 9,087,635)
cggcggtggcgatggtctatattctccggagtcgttcagcggcgtggtgtccacggggggatcgccacgtcacgcccgccgttcccgcgggtttcgacagctgtcgcgcgccgccggttccccgatgcgttctcgcaccggtctgcgcccatagtgaacgtccgtccatcggacacgggggagctgcatagtgctgtcaatcagatctggtcgatccatgggcgtcggggccctggtcgccggcctcaccaccacgatggtgttctgcgccacgccgacggtgccggtgctcgcggccgggtcggccgccacggccgcggcgtccgccgtggatgatcacaccaacgtcgccacggacgaggacaaggtcaaggcggccgccgcgatcggcgtcaacccgggcatcgacctgctcgtcctggacgaccagggcttcgtcttcgccatctaccagcgcgccgaggccgggccgtacgtgaaggccgaggcgctgcgcacctacctgtcgtcggacccgcacgccgcctacgacttcatcgtccgcggcatcttcgtcgcggccggcgacgacgcccaggccaagatcgccgagacggccgcccgggcccgccggagctcggtggcggtcaccgtcgggctggactcgtccgacatcgcgctgatcgagaagaacgaccgcgacttcatcttcgcggtgtggcagcgggtcaccgccggcagccacgtctggaccgccgcgcagacggcgatcgccgacggcaccggccaggccgagtgggacgccttcctgaacaccggggcggcggccgccgccgagcaggatctgcgcgacgtgatcatcgacggcgacgaggcgcaggccgcgaagctgcgggccgcgcgactcgtcaccgccaagaaggcgctgctgcagctgttgctgttgccggtgaccgacgaggtcgtcaacgcgccggaccggcagtacgtgctgttcgtccacaacaacgccaagggcaccgaggtcttgctggcctcgcaggcggccctcaacgcgccggacgacaagctggcgcaggcgctgaccgacttcatcttcaccggcggcgcggccgccaacaagcgggacgaggacgccgccgccgccaaggagctggccggctaccgcgaccgcgtcaccgccatccgggacgcggccaaggccgacggtttccagccgaacctggtcgacgccgccaaccgggcgctcaccgacggcaccctgctcaccctgcagaccttcctgctcaagggccaggacgagccccgggccacggacgaacagtggcgcgccaccttcttcaaggatttcaacggcgaccgtaaggccgacctcgcgggtatcaccagcggcggcaacctgttcctctacaccggcagcggtgccggcaagctgaccgccggcggtgccatgtgggccaccgacggcagctggggccggatcaaggcgatcgccgcggccgacttcaacggcgaccgcaagaccgacgtcgccgcgatcaacagcgtcggcaacctggtgctgtacgccggtaacggcgcgggcaagctgaccaacgcgggtgccatgtgggccgccgacggcagctggggcaacttcaaggcgatcgccgcgggtgacttcaacggcgaccgcaagaccgacatcgccggcatcagcggcggcggcaacctgatcctctacgccggcgacggcgccggcaagctgaccaacgcgggtgccatgtgggccaccgacggcagctggggccggatcaaggcgatcgccgcgggcgacttcaacggcgaccgcaagaccgacctcgccgcgatcaacagcgtcggcaacctggtgctgtacgccggcgacggcgcgggcaagctgaccaacgcgggtgccatgtgggccgccgacggcagctggggcaacatcaaggcgatcagcgccggcgactacaacggcggcggggccgtcgacctcgccgcgatcaacagcgccggcaacctggtgctgtacgccggcaacggcgcgggcaagctgaccaacgcgggcgccatgtgggccaccgacggcagctggggcggcatgaaggcgatcagctgaccgccgggtgagatgacgctgcgggccggcctcgatcggaactttccggtcgaggccggcccgcggcgccttgcccggtccggaagcggggttcagcagcgcgcccgcgaacgccgaccgttcagtatgggcggcattcgatgagcagcaggcgctgcggccccagccgggcggagatggcggcggtggccggatcgccgcaccgggacctctcggcggtccacccgttgacgtcgaaggtgtagaaccgggtcgctccggtaccgaggctgcagctgtcgtagtcgcagtccacgtgcgcgttgacaccgtcgatgcgccaggtgcccgggtcgagccagttgccggtggtcgagtggcaccaccagcggatgaaggtgtgcccggcgaccggcatggggggcgaccagggcgtgaacgcctcgccggagcgtttcaggtagatgccgccggccggcggaaaccggtcgttgtaggcggaggagatgtagacgtcaccgctgcaccgctcgaccatcatctcgttgccggcgtacgcgggtcgcgtgccggcgaacgcggccaggcaggccaggaccgcggtgaccgggatctcgcgccgtagcatcgggtgccttcctcgagtcggccgggaggctggtggaacgccccgattctccccgcgggtgcgggccggtcggcggatatggacgaagttcatcggtgtggcccgggtgacaggtgtactcgtagtgcatcccagcggccccggcggcgacgtacggtcgtggcgtggacaaccgatccgaggtgcgggacttcctgacgtcgcgccgcgccaagatctcaccggagcgggccggcattcccgggggtgggcagcgccgcgtgccggggctgcggcgcagtgaggtggcggcgctcgccgggatgagcgtggagtattacgcgaagctggagcgcggccagctggccggggtgtcggccggcgtgctggaggcgatctcccgggcgttgcagctcgacgacgccgagcgggtccacctgctgcgcctggcgcaggcggcgaacggcagcagccggttggtccggccgcagcgccggccgaaggcgtgggtggtgcggccgagcctgcagtggtcgatcgacgcgatcaccgtgccggcgacggtggccaacgggcggcaggacgtgctggccgcgaaccatctgggccgggcgatgttcagtgacctgttcgccgatccggtcagcccgccgaacttcgggcggttcatcttcctggacagcgcggcccggcggttctacccggattgggatctggccgcggacatgctggtggcgaacctgcggaccgcggccggcaaggatccgcacgacggcgagctgcacgagctggtgggggagctgtcgacccgcagtgacgagttccgccgccggtggggtgcccacaacgtgcgcacccacggaaccggcgtcaagcagtttcggcaccacatcgtgggggatctgagtctggcgtacgaaagtctcgacctgcgcgccgagccggatctgacgctgaccgtctactccgcggagccggggtccacgaccgcgcacgccctgacgctgctggcgtcgtgggcggcgacatacgtatgaacagcacaccggagggcatcattctcaccgtcaacgcgatcgccgcgacctcggccaccgacccgctcgtgcgcaccaccgtcgagcggcgcgacctggggccgcgcgatgtactgatcgaaatccgctacgccggcatctgccactccgacatccacaccgtgcgcggggagtggggtgacgtcgcgtacccgctgaccgtgggtcacgagatcgtcggccgggtcgccgaggtcggtgccgaggtcagccgccaccgggtcgatgaccgggtcggcgtcggctgcatggtcaactcctgccgggagtgcgacaactgcaaggccggccaggagcagtactgcaccggcggcaacgtgggcacgtacgccagcgtcgaccgggacggcacgatcacccagggcggctattccacgcacgtggtggtcgacgaggacttcgtgctgcgggtgccggagagcatcccctacgaggcggcggctccgctgctctgtgccgggatcaccacgtactccccgctgtcgcactggaaggccgggccgggcaagagggtcgcggtcgtcggcatgggcggtctcggtcacatggccgtgaagatcgccgcggcgatgggcgccgaggtcaccgtgctctcacagacgctcagcaagaaggacgacggcttgcggtacggggcgcagcactactacgcgaccagcgacccggccactttcgaaacgctcagcggaaccttcgacctgatcatcaacaccgtcagcgcgccgatcgacatgggcgcgcacctgcgcctgctgcgcctggacggcaccctggtcagcgtcggggccccgccggagccgctgccggtgccggtgttctcgctgttcggcgcgcggcgttcgttcgccgggtcgagcatcggcgggatcgccgagacccaggagatgctggacttctgcgccgagcgcgggatcgccccggagatcgagctgatcggcgccgaccaggtcaacgaggcgtacgagcgggtgctgaagtcggacgtccgctaccgcttcgtgatcgacgtcgacaccctgcgctgaccgggcaggcggctcaccgagcgggtgagccgcctctccccccgtacgtcagggcagcgatccgaccgcggtgcgcccgacgacgtcgaggatcgcgtcgctgttcggcgggtgcagggtgccggtgcgcacgtcgcggtacagccgttccagctcgttggtccggctgaccgcggacgcgcccgccacctgtaccgcgatgtccaccacctgccgtgccgtgccggtggtgaactccttggcggcgaacagccgggacgtccaccagtcaccgtggtcgacgccggcgtccaggtcggcggtggtctgctcgagcagcgcccaggccgcgtcgagcaggatctcggcctgccccagttgccgctgcacggccggcttgtcggcgtgccgctgcccgggcagggccagcgacccgcgctcctgggcggagagttcggccaggtccagggcccgccgcgcgatgccgaaatagacgttggccaccaacggcagataccactgcaggatgccgaggatgtacggcggatagggctgaccgatcgcgtgcgcgccgacgaactgggcggccggcacccgcacgttctccaggatcgtgtcatcgctggccgtggcccggacgccgagcgcgtcccaggtcctctcggtgcgcaccccgggcgcgtcccggtcgacgaacaggtgcacgatccgcgggtgttccgggtcggagtcgtcgcgggcgtggatgcccagcttgtcccagaccggggagagcgaggtgaacgtcttgcgtccggtgaccagccacgacccgtcctcctgcggcaccgcgagggtggtcgcgtcgtcgagtcccaggtcgttgccgcgctcgccgtgcccggccgccagcaccttgccgtccgccacgtcccgcagcagccagcccaggtcctcgacacccgcggcggtcaccgcggtggccggcccggtccagtacaggtgcatggtgaccgcgagcgcggtggccggcgcccagtaggccagccgccgctgctcgcgggccagcgccgcgaagcccaggccgccgcccccgagcgcggccgggatcgcggcccgcagatagccgcgggcgcgcaggtcctcgaagtcctcggtgaagaaccggttgtcccggtcgtatccggcggcccgttcgtggaagcgccggtagtcgtcgtcgctgaagtaggcggacggttccgccttctcgaacagcggcgaggtggaactcgcgatccgctgcgtcatgcggtggctccgttctgcacggtttaggtggtggcgggtgccgggacgggtcgtggggtgaggccggtgatccggccgtcggtgagcacggcgagccagccggcctcgggcggggtgcggccgatcgcctcggcgaccggctcaccggcgccgaccgtgggcagcggctgggcgaaggcggccagtggcgcgtccggtgcggccccggcgaccgcgacggccggcacgacgccgagcacgtccccgggcgacgggtgcggggtggtctgcccggggcgcgggaggaccagcagcgcgaccggggcgctgccgaggtcccgtacccgggaatcggccggtaggtgaagcgggacggcgagcggcaacccaccggccagcgggccgggtgcggtcggcgccgggaagccggcccggcgcagccagccgtcgtcgaagtacttcgacaggtaggcccgcccggagtccggggccagcaccaccaccaggtcgtccggccccaggtcgcgggccacccgcagggccgcggcgaccgccgtgccggtcgacgcgccggccaggatgccctcttcgcgggccaggcggcgggtggtctcgatcgactcccggtcactgatccgctcgatgcggtgcacgacctgccgatggtacgactgtggccagacgtcctcgaccgtgtccgggtgcacgtagtggccgatgctctccacgtagtacggactgccgtcgcccccgccgtagaccgagttctccgggtcggcgccgatcaccgtgaccgggccggccgagcgcaggtacgccccggcgccgctgatcgtgccgccggtgcccaccccggccacgaagtgggtgatccggccgccggtctgccgccagatctccgggccggtggtggccaggtgcgcacccgggttggccgggttgtcgtactgcccggcgagccagccgcccggggtctgctcggcgagccgggcggcgacctgcgagacgtgccgcgggtcctcgcgggtcaccccgccgatggtgatcaccacctcggcgccgtaggcgcgcagcgtcgcgatcttctcggcgctgctcttgtcgggcaccacaacgaccgcccgatagccgcgctgcgcggcgatcatggcgagcccgaccccggtgttgccggaggtgccctcgacgatcaccccgcccgggcgtagctcgccggacgcctcggcggcccgcaccatggccagcgcggcccggtccttgacgctgccgcccgggttgaggaactccgccttgagatggacctcggcggtcaggccggcggtgatccgggtcagccggatcagcggggtgtcgccgatggcatcgagcacactcatgccaataacctagcaaacacataggggaactaggctgttgagcatattaagccgataggcattctagtccactttcgacaggcgttacggttcgccgaaagcggtccccgcccggcaagaaggtatccacgatgaccgatagcctcagttcgcaagccccgaccggcgagccgggcgacgacgccccggtcgaggcgaacgtcgacctcgacgtgccggccggcctgtcccggcggcgcctgttcacctccgcggcggtcggcgccggcgtcctggccgccggtggcctggccgggtgggccgtcctgcgcggccgcgacgaaccgcagcccgccgcggccggtggcctgaccgtcacccggtcctgggccgggcagcagctcacgctcaccacccccagcggcgcgtgcgacgccccgctggtcgccgcatacgagaagggcttcttcaccaaggccgggctcgacgtcgtgctgaagaaggccggcaccgacgaggacatcaccgcggcggtcggctccggcaagtacgtcgcctccaacggcatcttcttcaactacctgggcccgatctacaacggcaccccggtcaagctcagcggcggcctgcacctcggctgcctcgacctctacgtccgcaacgacggctcggtggcctcggtcgccccgctcaagggccggaggatcgggtcagcaacctgcagggctcggccacctacttcttctccctcgacctgctcgccaccagcgcggcgctgctcgaggtccaggatgcggcgatcctcgtggtcgccaccccggccgcccgcggcgcctactccggagccctcaaggtgctgctcgaccacctgccggcgaacgcgctggccggcgtggtcgcggtgccggtcgtcgccgcggaggcgcagacccaggcggacgccgccgaggcggtcctggcccggctgctcagcgaactgggcgcggacgtcgtcgacttcggcctgaccgccgtcggcccggaactcaccgagcccgcctcggtcgccgcaacctacgccgcggccatcatcggctgaccagcccgcggccgctccggaccgtcggcggccgcgcgttgggccgctccggaccgtcggcggccgcgccctaccggccgtcccgcgccctaccggccgtcccgcgcccttgccgccttgcgcctttcggcgggctcgcggtccgtccgcgctcgcggccccatcgcgcctgcggccatccacactccctgtttcgactgcttccgtggcgtcggcgtcggcgtccgtgcggccgcgcgcgtcgtttcggcgcccgtcttcggcggtcggggtctcctgccgttcgggggatgcgtggctggcgggtggtggtcagcgggtggtcaggggtgggcgaagcgcttcgatgatgcggtggggggcggtgggcgtggaccagtcggcgttgatctcggcgaagcggatgacgccggtgcggtcggcgacgaccgtggcggcgaacggcaggacggagcggccggtgcccaggatcggttgcgcgtcggggctgcggaagccgatgttgaaggcgtcgatcagcgtgtgccgggggtcggcggtgacgaagaagtccagctcgtggcggcgcttgacggcctccaggcggccgggctcctgcgggctgacggcgaccaggtgggcgtccagcggggtcagggccgggacgagcgcgtcgcggtaggtgtgcagggcggcgtcgcactccggggagctcgcgtgccggaagaacagcaggacgaccgggccggtgtcgcgcagtcggttcaggtggatcgggcccaggtccacttcgagcagtggcatgtcggggaggcggtcgccgggggtgaccatccggttccagatggcgttgctctccagctgcagccggaactgctgatcgtcggtgcgacgtcgcacggtggtggtcatgcgccgatattacctactgcaaccataggaattctagttgacctctgtgaatgtcttgtcaccatagtacgtttgacgttatatgtcggggcccgtagtctgccgatcatgcaggaaccgacgttcttgatcctcaccgccctggcggccgagccggcacacggctacggcgtgatccgggccgtgcgggagctgtccgagggtgaggtggtgctgcggcccggcaccctctacggggcgctcgaccggctcaccgagcagggcctgatcgaggtcgaccgggaggaggcggtggacggccggctgcgccgctactaccggctcaccgacagcggaaccgccgcgctcgccggccaggtctagctagctaggcctcgcgcccggcggcggaacgggcccgcaggtcgctcccggcaccggcccgcgactcgccttcggcggcgctgcgtccgctgcttccggtcgcccgcggctgggcttcggtgacggtgggtccgctgcttccggccgtccgcggctcgccttcggtggtgggctgtgagtgatcggctggaggctcactatcggcggctgatgtgggcatatccgcgggactaccgcgagcggcacggcgtcgaggtgatcaccacgttgctggacatggcggcggacgaacggcatcggccgagcccggggcaggcgctgcacctgatcctctgcggtctccgccagcggttccggctgccggcccggcgtccgctcgcgctggccggagccctgctcgccgcggtgatcgtgggcgggttcggcggggtggccggcacctggttgggctggcggacggccgcggggattccggccgaggccgccctgcgatccctcaacaccgcgatgatcggcacgtcgacgccggccgaggtccaccccgaggagtcggcgatgaaggggccgggggtggcgctcatcacccacgggggcagagactattcgcccgggcgcatccgggccgcgctcaccgccgccgggtggcggacaacggcgtaccgggagtttcccgtcggcgagcacgagcacctcttcaccttcgccgccaccaggggccggctgaaactcgacggcagcggcctggtggtcgacagtgccgagggcgccttccagaattcgtaccggaccgacgtgtggccggtggagcccgcggtggtgcgcccgctcaccgttgccggcatggccgggggagcggtcgtcgggtggctggtggccgcggctctcgcctaccgggtgcggcgggggacccgggcccggcggctgttggcgagcggctcctcggcggtcgcgctctcggcggcggcggtgcccgcgttcgtgcacggctgtgcgacctgtcaggtgctcgtctatgccgagggctcgccggttccgtacatcacctacggtccgggcgacggcatcccggcctggcccgggacgatcgtcgccctgatcgccctggcggccgccctgggcgtgacgtggcggcgtcgcggcgccgcggcgtccgtggccggcccggccggcatggaggaggcggccggctgaggtccgctcggccgctgtcgaggtgggccggccgccgcgggccacgtggcgggatcggcgatgggcggtcagtcgatctgcgggcgggtgagcgcggggtgaggcggccggtgaggcgctcggcaggtggctggctgccgggtgaggcgctcggcaggtggctggctgccgggtgaggcggtcggtcaggcggtcggcaggcgggtggctgccgggcgaggcgggccgggtcgggcggtcatagagttggcggcatgcgtatcgactttgcccgatcggtcaggtcgcgtctagggatcgagtgggagatcgcgtgcgtcgaccgccgcagtggcgagctggccgccgcggcccccgagttgctcgccaaggtcggtggagcggccggttttccgcacgtcaccggggagctgctgacgaacacggtggaggtggtcagcgccccgcaccatcgggtggctcgcgcggtcgacgatctggaccggctggtggagcagctcgccggggtcgccgagccgatgggggtcgacctgatctcctcgggcacgcacccgttcagccagtggttccggcaacgggtgacgcccggcaagccgcgctacgacacgctgatcgaccgcacccagtggtggggccggcagatgatgatctggggtgtgcacgtgcacgtcgcggtggaggaccggcggaaggtgctgccgatcgtggacgggctgctgacgtacctgccgcattttcaggcgttcagcgcgtcgagtccgttctgggcgggggagacgacggggtacgcctcgaatcgcgccctgatgttccagcagttgccgaccgccgggctgccgccgcagctcgccgactgggcggcctacgaggcactggtcgccgacctgcggcacaccggggtgatcgaggagctgaacgagttgcgctgggacatccggccggcgccccggtggggcacgatcgaggtgcgcaccttcgacggtatgccgacgctgcgcgagatcggtgcgctcgcggcgctcacccagtgcctggtggagttcttctcccgggagctggacgccgggcggacggtgccccggttgcagccgtggttcgtgcgggagaacaagtggcgggccgcccggtacgggatggaggccatcgtgatccgcaccgcggccggggacgagcggctggtcaccgaggatctggtgggtgagttgctgccgcggctggcgccggtggccgagtcgctggggtgtgtggcggagctggccgggctggcggagatcgtcgagcacggcgccagctaccagcggcagttgcgggtggcggcggcgaacgcgggtagtttgaaggcggtcgtgtcgtcgctcgtccgcgaactgcgtgacaacctcctgcatcagtagggtttacggagggaagatggcgtacgcgtacaccgccgtgacggcggagagcgaggtcgccgcgctcaccggtgacctgatccggttcgacaccaccaatgccagtgacgacggcggcccgggcaccgaacgtccggccgcggagtacgtcgcggagaagctcgccgaggtcggctatgaggtgacgtacgtcgagtcgggcgcccgtggccgcggcaacgtgatcgcccggctgaccggatccgatcagcagcgaggggcgctgctggtgcacggtcacctggacgtggtaccggccgatgccgccgagtagagcgtgcacccgttctccggggaggtccgcgacgggtacgtgtggggccgcggcgcggtcgacatgaagggcagcctcgcggtcagcctggccgtcgcccgccggctcaaacgggagaacgtgacgccgccgcgggatctcgtcttcgcctatgtcgccgacgaggaggccggcggcttccacggcgcccgctggctggccgagcatcgcccggagctgttcgacggggtgaccgaggcgatcagcgaggtcggcggcttctcggtgaccgtcggggacggcgcccgggcgtacctggtggagaccgccgagaagggggtcgcgtggatccggctgctggcccgcgggacggccgggcacggctcgctgctgcacgacgacaacgcggtggcgaagctggccgccgcgccgtgctcggcccggggatcgacgtacggtgggacagtcttcccggggtcgagaccgatttccgcggtacgttggtggatgcgatggccgcggcgatcggcgccgaggacccgggggcgcgcctgctgccgtacatgctgtcggccagcaccgatgccaagagcttccagcgtctgggcatccggcatttcgggttcgccccgctgcgcctgcccccggagctggatttcaccgcgctcttccacggcgtcgacgaacgggtgccggtggccgcgctcaccttcggcacccgggtgctggaccgcctgctgcgtaactcctaatatcccgtcggtttaataggatatactgccgggtgtgccgaagaattcccatgtgctcgatcaggcctcctgggcctccttgaccgggccgcacgcccacttcgcgcagggcgacgggcgggcgctgcgctacccggccgaggtctccgggatcaccgcggcgccgccggtgcaggacgaccgggtctgggccgacctggccgccctggtcggcccggccggggtggcccggttgtcgtgcgacatcgcgccgccaccggccgggtggaccgtcgaataccgcggcgaaggcgggcaactggtggccaccgacgcgctgcgctccgaacgcgccccggaggtggtgacgctcggcgcggacgacgtaccggaaatgctcgacctggtcgcccgaacccggcccggcccgttcgagcccggcacccaccgtctgggcgtctacctgggcatccggcgcggcggccggctcgtcgcgatggccggcgaacgggtgcacccgccgggatggaccgagatcagcgccgtctgcaccgacccgcgacaccgcgggcagggcctggccggcgtgctggtgcgggcggtggcgcacggcatccgtgagcgcggggagacgccgatgctgcacgcctccggcggcaacgtcgacgccatccgcctctacctgtccctcggtttcgcactgcgccgcacccggcagttcacggtgctgcgcgccccgcgggacgccggctgacgactgtccgatccggacgatccgaccaccggccgcgggcgttgccccggggatggcagccgtcagccgatagggtgatgtattggctcatcagccgcggttagcctgcggtgatgtcgacgaccgggctctggggtgtgccgggctggtggattcctctcgtgatcacggtgagcgtcctgtcggcctcctcgtcaggtttacgagtgtggtctcaccatcgtccaacggctgccgctgtcatcgtcgttgcggggtgtgcggcagccgcggccgtcatggtcaccgaaaacgatccgcggcgagcgctcgtcgcgtatctcggcctcgctgtggtcaatgccgccgctgtcatggtcgttcggttccgatcgcatgccggcttcgagctgaaggaactggtggccggcgccattctggccgtccttctccccggcctggtctccctcgccacccgggcctggcaggcgagatgggatgtcggtaaagacaagacgatcttgtacatcctggtcgggtcagcggcgttgatctgttacgtcggtaaaccggcgtatcggatgatggccgctgccgaacgatcggcgaacccgcgggccggcgtgagcctcatggttctgcccatcgccctgttctgcgccttcctgctgacgggcacggcggtgctgttgcttctcggcacgaggatcggcttcgagcccgcgcacagcggagcgccgccgtcggcgacgtacgcgcggacctacgtcttcgtcgcgtgcgcactggtcgcgctcgtggctgtttcggccgcgcggttgagccaaccgaccgctacctgtagtgacgcctggaaaccgaatcccgccgccctcgcgctgatgtcgatggccgtggtgtccgtgatcgtggcggtggcatgcgagacggcggtcgcgcggacgccggtggcatggccgcttcgcctgtatttcttcgtcctctccgcggtcatcgggctcctgtacggcgaggaggtggtcagcacgccggtgcgactgcacgtccttcggcccgaatggccgagctgggtgctcggaagcgcatgcggagcgatgatggggtcgtcctgctactggttggcctgctatcggatgtggacctccggcggccacctggccgacatctcctccgcggtgggggccctcggcgtactgtggctcgtgttcgtggtcgccgccgcggtggtctacgtcttcgccttcgcctccgatccgtcgcatcagcaactgaccgcgaagagcgctgcgagcaacacctttcaggggcaggcgctgtacgccggcctcgtcaccgtcgtgctgttcgtgcccagtcagatcggtggtcggctcggcggagacatgttggccgatctgccggcgatagcgtctttttgtggattcgcggcactcctgtggggagtctactcattcaccaccaagcgcaacggggaacatctggcgtcggagatgacgcgcacgattccccaggccggcatgagaaccggcactgccgcggaggcggcggagctgacggcgaagttccggcagcgcttggcggagcacctgaactggcagaaccacctgggccgcgcgattctgatcctgtccctggtgggcatcggagccgctgtgcaccgcgtcaaggaggaggtcgccgcggaggcgggactcgacacgacctagccgcgggcgttgccggtccggttcccactccgtcgcatcgacacgagggccagcacggcgagccccgcggcgcccgccaggcctgccgctccggtgaatctcgaagccgcggtagatctcgtcgcgacgttgtcgtagaggacgaggccggcgaacgcaacggttgccgcaccggcagagatcagtgacctgcgcacggacggtgccacggccggcgaccggatcgccctggtgagggcgagtgccgacgcgccggcgaaagcggccgccgcgcccgagagaaaagccgcgtggtaccagccggccgcagtgaagtgatgcggtcgaggaagggtccagttcagcgccgggtgggggtccatcagccagccgacctgactggcgaccccgatggagaaaccgaataccgcccccatgccggcgatcgccctttcgtgccgtgcggcggccaggccggagagcgacagcgacaggcaggcggccatcgtcgggagcagcacggcgtctccccaggtcgcggactcgtaggtgaacaggccgcgaagctcgtgggggccgtccgcgcacaggtgaaagccgtacatggcaccgaagccggccagaaacgtcccggcggccacgacggccgccctccgtacctcaggtctcatggtcgtccttcgtggcgcgaaggggtgggggagcgtccgccgtccccgctggcgatcctcgctgccggcctcgaccgaggcaagcctcgatcgtcagtcgaggccctcgacgatgcggaagtcccgctcgacgccgtccgcgagggcggccagcgcctcctggtaggccgcgctctcgtgggcggcgaccgcctgctcgtagctgtcgaactcgaccaggacggtgcgctcggccaccccgtcgtcgtgtgcggcgacccggccgccgcggacgagggtccgcccgcccgcggcccggacggcgggcccggccagctggttgtaggcggccagcttcgccgggtcggcgatggtgcggtaggcgctgacccaatagcccttggccacggttcctcctctgctcggcgacgacgccaacgtacgccccgagcccgggccgagccccggtggggcaccgcggctagacgtacgacacatttttcctatcgaagttgtggggtatggtgatggccttccgcacctctcgatcatcatccggagcaacagatgtcagaccagtccgcccagccggttctgcccacccgtaagcgcagccgctggccctggatcgccgctgccgccgtcgtcgtcgtggcagccggcgtggtcgtcggaatcgtcgccaccaaggacgactccgccgacgccaccaccgggggcaccaaggcgcagaccgtgcgcatcggtgtcgccgacgcgtccgcgccgtactggaagacctacaccgacctggcgaagcagaagctgaacgtcaccgtcgagctggtcaacttcaacgactacagccagccgaacccggcgctcaagcagaagcagctggagctcaaccagttccagcacatccagtacctggcgaactacaacgtcaccgccaaggacgacctgcagccgatcggcgccaccgcggtctacccgctgccgctgtactcgctgaagttcaccaagccggccgacttcccggcggacgccaaggtggccatcccgaacgacgcgatcaaccaggcccgcggcctgctcgtgctgcaggcggccgggctggtcacgctgaagaacggcggcagcgccttctccagcaccgccgacgtcgagtccaagaaggtcgacgtggtcaccctggacgcctcgcagaccgcgggcgcgctgcagagcggctcggtggtcggcgcgatcgtcaacaacaactacgccaccagcgcgaagctgccccgcaccaacgcgatcttccaggacgacccggccagtgacagcgccgcgccgtacgtgaacatcttcaccgcccgggccgccgacaaggacaacccgacctacctgaagctggccgagctctaccacgacccgtcggtggagaagggcgtccaggaggccaacggcggcgtcgcggtgctgcgcaccgtccccgccgccgacctccaggcgctgctgaagaaggtccaggaccaggccgtcgccgcgggcaagtaattcaagatcgtgacttatgtacgtcttcagcatgtgaccaagacgttcacccggggccgccgcgggccccgggtggccgccctcgacgatgtcagcctggaggtggccaagggtgaggtgttcggcgtcatcggccactccggggccggcaagagcacgctgatccggctgatcaacgggctggagacaccgaccagcgggcaggtctgggtcggtgaccacgacatcgccgcactgtccgagaaggatcgccgtggcgtgcgccgggagatcggcatgatcttccagcagttcaacctgttccggtcgcgcacggtggccggcaacgtggcatacccgctgaaggtcgccggggtcgagaaggccgaacgtgaccggcgggtggcccggctgctcgacttcgtgggcctgctggaccgcgcccacgaccacccggagcagctgtccggcgggcagaagcagcgggtggggatcgcccgggcgctggctaccgacccggcactgctgctcgccgacgaggcgaccagcgcgctggacccgaagaccacggccgaggtcctcgacctgctccggcgggtcaacaaggagctcggcgtgaccatcgtgctgatcacccacgagatggacgtgatccgcgcggtggccgaccgggtcgcggtgatggacgccggccggatcgccgaaagcgggccggtgtacgacgtgttcgccgaacccgccagcacgacggcggccgacttcgtgcacgacgcgctgcgggaccgtccttcggagcggacgctggagcgattgcggcgtacccaccggggccggatcgtgaccgtggcggtccgtgaccggaccgccctgtcccgcgtcttcctcgaccgtcaggtcgccgcggagctgatcttcggcggcatcagcgagctgcaggaacgggcggtgggcagcctcaccttcgagctgaccgggtccgccgacgggatcgacggggcgctggccgacctgcgcgccgccggcgtctcggtggaggagcactgacgtggacgaattcctcaccaacctgccggtcttccgggaggcgatcgggcagaccttctacatcgtgagcatctcggtggtcgcgggtgggctgctcggcctggcgctcggactgatcctgtacgccaccaggcccgggagcctgctcgccaaccgggcggtcttcctgatcgtgaacatcctggtcaacatcgtacgaccgattccgttcgtgatctttctgaccgcgatccagccgctgatgctcgccacgatcggcacgacgatcggcaccgacgcggtgaccttcgcgctgtcgctggcggcggcgttcgcggtcagccggatcatcgaacagaacctgctcgccgtggaacccggcgtgatcgaggcggcccgggcggccggcgcccggccgatcagcatcctgctgaccgtggtcgtgcccgaagcgctcgggccggtcatcctcggctacacgttcatcttcgtcggggtggtcgacatgtccgcccaggcgggactgttcggcggcggcgggctcggtgacttcgcggtcacctacgggtcgcagcggtacaactggccggtcgtctacatcacggtcgcgacgatcatcgtgatcgtgcaggccgggcagttcctcgggaacttcctggcgcggcgggcgctgcgccgataatccggttcagtcacccgggtggcgggtagtcggggtcggtgaccaccgaaggacccgccgcctgggcgccgctgcggatcgccgccttccgcgcgctctggctcgcgctgctggccagcaacatcggcacctggatgcagaccgtcggcgcccagtggctgctcgtcgaacactccggctccgacacgctggtcgccgtcgtgcagaccgccagcaccctgccgatcgtgctgctcgccctgccgtccggggcgctcgccgacaccttcgaccggcgccggctgctgatcttcgtgcagatcttcctggccgccgtcggcgtgctgctcaccgtgctcacccaggccggccggatgccgcccagcctgctgctcaccctgaccttcgcgctcggcgccggtcaggccatgaccgcgcccgcctggcaggcggtcatccccgagatggtgccgcgcagccagctcgcctcggcctccgcgctcggcgcgatcagcatgaacctggcccgcgccgtcggacccgcggtcgccggcgtgctgatcgcgcagaccggcaccgcggtcgtcttcgggctcaacaccctgtcgtacgcggtcttcgccctggtcctcgtgcgctggcgcccggccgcaccggacccggccgccgtgcccgaaccgttcggcgcggcgatgcggtccggcagccgatacgtgcgccattccccggtcgtacggcgcatcctgctccgtgcctcgctgttcctggtgcccggcagcgcgctgtgggcgctgctgccgctggtcgccgaacgccgcctcggcctcggctccggcggttacggcgtcctgctggccgcggtcggcgccggagcggtggtcggcgccctgctgctgccccggatgcgggcccgctggtcgatgaaccgcctgctgctgatcgccggtgtcgtcttcaccgcgatcctggccgtgctcggcctggcccgctccgagatcctggtgatcatcgtgctggtgccggccgggatcgcctgggtgatggtgctgtccaacgtcaacgcggcgatgcagctcttcctgccgaactgggtgcgtgcccgcgggctggccgtctaccagatggtgttcgccggcgcgcaggccgtcggcgcgctcgcctggggcgccctgtccgacgtgaccgggctgcccgcgacgctggtcgcttcggcggtgctgatgctggccggggtggccacgctgggccgctggccgatgcgcgacaccagcggcctcaaccgggatccggccgtgtactggccggagccgcacctggaactcgaccccgacgagcacgacggaccggtgctggtgatggccggttacccgatcagcccggaccgggagaccgagttcgtgtcggcgatgcacgacgtgcggcgcagccgcctgcgcaccggcgcggaacgctggggcctgttccgcgacggcgaacggcccggccggttcgtcgaggtctatctggtccccagctgggacgagcacctgcggcagcactccggccggctgaccggcaccgaccaggccatcgaggagcgggcgctggccctggcggacggtccgcccgaggtcagccacctgctgtccgaggacgtctagtgctgccccaccagcagcaggaaggtgcgagccaggccgaactgctcggtgcgcggccagtccagcgctgccagggcggcctcggccggctcgtggcggcggccgttgatccggacctcgcattcggtgaagtcaccgccctgaccgatcagcaggcggatgccgttcaggtgcggccggtccagcgccggcgcgatgatcggggccagcgccgaccacggcatctcgtcggcgatccactgctgcttgaccggtgagtcgtcgacggaccagccggtgattcccccgacgatggtgtgccagccggggaaggcgccctcctcgtcggcggcgatgtgggtcgcgagccggccctgctgctccaccatctccagcacggtgaccacagtggtcgcgatccacgcgccgatcgcctgccgggctccctccaccggatccgcggcgagacccagggtgcagtcggtgatcgtcggcacgtccgggcggtcggcgttcagcaggatctccaggtccagatgcctggggtcggcgttgtccgcgggcagtagccggacacccatcgacccggagcgcagcatcggaccctcggcgagtcgccagttcccgcccacctcgttgagcatcggggcggcgatctcaagtacacgttcggccgggagcggctgcgagttgatcatcggggcaatctaccgccccgcgaccggccatccggtcacggacaacggctgcgagaggcgggggcccatgccggaaccgtcgaggtccttctggtgctgatctgggccgggcatctccggcagcactccggccggctgaccggcaccgatcaggcgatcgtggagcgggcgctggccctacttgttcggcgtgcgactgacaatgggactcgcccggccgctagggctatcgcggagcgtggattcggctcaggtgattggtgatgtcgcgggcaagctcaagctcggccagctcccttctccttctatccgcggctatgagagtgcgtcgttggtctctggttagcgtgtgcacgtctttccgggagaaaccgctcgcgagcatatggtgcaccaggttgcgggaaccgtttcgtggcccaccgcggcatagacggttggattggcagcagctgccagctgcggtgttctggcgaagtagcgcacggtccagcggtcccgttctgcgggccatccggtgagttgtgcttgaacggcgacgtcacggtcataccaccaagactccgctgggcccgcggcatcgaggaccggcggtggcaacgactcctcatgcgttatcggcaggacacccgacggagtgctgcactcgaaggtcctatggaaccaaacctcgacctcggccaggagcgcgtgtcgctcaatcctctgatcgacgcttcggtcgatgacacggtatggccactgaccgggctccatcgcggtgcgcccatcgagaagaacgtcgagatcccaagtccagtcgccgtccaggaccccggtgaaagccagcccgagcgggccgtgacggactatcggaaggccgtccagaccgtactccatgtggttgccaccgaggacgcggtaacgcaggccgccatagcgttgttcaaacctgaccatcgcctcgaggagttcttcgggagccggtccttcgtaggttctaatccaggccggggccgacgaccggatcgccgactcggtcatatgccggccgcggtgcgaacggtcccgcaggaatccgtgtacacggtctgtcaggccaagatcatcagcgatgtatatacgatcaacttagcatcgttcaccggccgctcggtgatgggcgcctaccgaatcagcgcacaactcggcagatcaaggcgtcaacgtgggtaagtcacggagcgtgacgcctcccggttggccaacgcgcacgatcggcggcagaagagtggcccgggctgagatggagttcgtatagcaagaggagcactttggtcgaatcagttcgacatcccgggttcgactcaggtactcaacacgcgtagtgaagaatcagcgggtccaccgatcagggcgcgcggactaggagaaacgagatggcgcaccagggattatttcccgcacaccgctggatactcgctgcttcctgttgcctggcctgggccgctctcggtggttgtaccggcgacgacaaatcagtctccgcgccagcaccttcggtgaccaccgtcccggtggaagctacgttgcccagcctggcgccggctggcctgaagcagcaggccatcggtcatgacaacgtcaccggcggctggaccgccgacttggccggggacggccctgtcgacatcaccattgtctgtatcggcggtggtgacctagccgtcaactatcacaacccgtcacgccctctagggtcattcaaactgccctgcgacggaacgacgtcgaaaaactacgatgatgccgcaccgtcgggccccatcaccgtgacgatcaaacctgatggcgaccagcgttggtcggcgcgcctcgccagagggccgagatcgtgacgaacctttttcgggcggaacaggcggcctcgtgcgagcacactcccgactcgctggtctcggcatgtctgggcgtcggctgaccgacagagacgctaccaagcgtgacagctcgtccacggccggcgcggtggccgttgcggcgggcgcgaccggcggttccggccggtccaggcgaccgggttctgcttgaccggcgtcctgataatgggggtgctttgcggcatgggcgccaaactcggggctcgcgccgccgaccgcgccgacggatgacctatgtggagtggcccagaagccagatccagacagtgatcggcacactggccgccgccacggaaacgaacggaccatgacgtcatcaaaccgaactgagagcggttcactacgcatcacggtgcgaggacactgggttaaccgttggtggttggtagccttcaccaggccgtacgttcgcgtggacgggcatgagcaccaggtcgcctggggacgcgagcagacgttaccgctatcggtaggcgcgcattccctggaaacattcatccgctaccggggaatacgcgccgacctgggcgccgggcgactcgacttcaccgtgacacccgggcaggaggtctgtgtcgaagcaatcaacggggtgaccaatggcacgcccttcaccccgcggatgctgcctcgaagttagccacactccctctggcgacccgttccgaaccagatcgctgctggcggcgcttgcctggtttcgtctgctgccctgatcgactggccgcaacgtcgacgccggccaacgtccgacccacggccagatccgtgcactcgacgggctcgtctcccactcgctggcttgtgactgaggcgggtgcccgagcgcccacatctccggcgcgggcatgggtgcggcaggcgggcgagcaataccgcttgcgccggcccggcaggttcggccgggagcggctgcgagttgatcatctgggagtccaccgcccgtcggccggccatcgggtcgcggacaatggctgctacaggaggtgaccatgccggaaccggccagggtgctgttggtgttcgggcgcggggtggtgcgtaccgcgagcggttacaccctcaccccgggcggggacgcgcgggtgcgcgcggccaccgcctacgtggcggcccaccgcgcggcgctgcccggtggcgaccggatccgggtcgtcttcaccggcggctggccggaggcgagcgccggagccgcaccaccgccggtcggcgcgcgcgagggggatctcatgctgcgggccgcccgcgcggccggcctggacgagcacgctgagctgtacgcggagacgcgctcgcgcagcaccctggagaacctgctgcacaccgtggaggacgggctgctgagtggatacgccttcgacgcccgggctccgctcggtctggtgacgcacgcctggcacctgccgcgcgtccgcttcctggccggccgggtgctgggactgaccggcccggcgctgcgcgacgtcccggcgcacggcggcgaggtgcacgacgaccggggcgcgctgctgctggcccggctgggcttcgccggcgcccgcgccgaccggctgttgcgccgcgaacgggggatggtcgcggtcggccgtctggcccggcgggtgatcaatggccggcctgggtatagacgccgcaccgtcggacagcagtgaaggagacccggtgccgtacgtcgttctactcccggtgttcaagccgggaccgcacctgtccgaactggtcaccgcgctgctggccgacggcccgcggccggcggaggtggtgatcgtcgacgacgggaccggtccggccgccgacgcccggctcgcggagctggcggcgcggggctgcacggtgctgcggcttccggcgaaccggggcaagggcgtcgccctcaagaccgggttccggcacatccgctcccggtttcccgaagcggatgtggtctgcgccgacggcgacggccagcacagcgtcgccgagatccgcgaggtggccgaccgctgccggcccggccgcgtcgtcctgggcgtgcgccgcttcgaccggatgccgccgcgcagccggttcggcaacaccgtgacccaggccgtcttccgggcggcgaccggccggaccgtctcggacacccagaccggcctgcgggcctaccccgccgacctgatcggggacctgtgcgccgtgccgggggagcgcttcgagtacgagatgaacgtgctgctgcactgcgcggcgaccgatcacccgatcgacgaggtgccgattcccgccacgtacctcgacgacaacgccggctcgcatttcagcgggctggccgactcggcgcggatctatgtcccgctgctgcgttatgccctgctcagccgggtggccccggcgagcacggtgccggccgagcgccggtagcagcggcggggccacgacccacacccgcgtggcgtcccgaacggtcgcccgtccataatggcagcccgccggggggcgacccgacgcataaccgccggccggtgggggtagaccggcatcgaggcagtcacatggatggaggcggcgatggtggatgcgcagtggccggggatccggcgcagccgtgcggccgttccgttgctggtgttactgctggccgtgctcagcgggtgtgtggcggtgcgggtgtcgagcgggcaggacgacagcggtgcggcgccggctgccgggtccgccgatgcggacgcgctggtgaccaaggcggtcaaggacgtcgagcggttctggacggccaagtacccgtcgctgcgccgcggcagggcgttcgagccgatcacgggtgggctgcacccgtacacccgatcggatccgccgccgccctgcggcggtgcgcaaacggcgtatcagccgaacgccttctactgcccggacggcgatttcatcgcctgggacgcgcagacgctgatcccgcggctgctgcagcagttcgggccgctgctggtcgcggtggtcttcgcgcacgagtacgggcatgccgtgcagagccggctgggtgtcaccgggcagccgaccgtcgtgctggaacagcaggcggactgtttcgccggggcgtggacggcggacgcgctggccggccggtcgccggcgttcaccgggatcacccccgagcagttggacaacacggtggccgggctgctgctgctccgcgaccagccggggacctcggcggcggccgagcaggcgcacggcaacgcgttcgaccggatccgtgccttccaggacggggtggagaagggcgtggccacctgcgcgggatacgacgccgacaccattccggtgaccgaggtgccgttcaagagccggcgcgatgccgccaacggcggtgatctgccgtacgccgatgccgtcgccgacctggccgacgacgcccagcagtactggtcgcggaccttcccgcagctcgcccaggcgcagtggcaggcggtgcgggtggagccgttcgagggcacgccgccgcagtgcgccacgccggacagcaccgcgggcgggtcggccttctactgccaggacggggacttcgtggctttcgacaacgcccggctggggccgcagctgtaccggaacatcggcgacaacgcgatcggcatgctgctcggtgacctgttcgcccgggccgcccaggatcggcgggggcgcagcaccaccgaccgggccgggcagctggcggtggactgcctggccgggtcgtggaccaacgacctgctcaggcgcccggagggagcgagtctgaccctctccccgggtgacctggatgaggcggtggcggcgttgctggccctcggccgagccggtgggaagtccgggaccagcgccttcgaccggatcgcggcgtaccgcagcggggtgctgcagggggtgtccgcctgtagctgatcatcggtagccggcggtgacgatgccggcctggaccgcgttgtcggtggcgtcgctcgggtatccggcgacgatggcgccctcgtagaaggtgcccgcgctctggttggtgttgtcgatgcagcagtcaccgccgctgccgaggatgatcgcgccctgtttgcgcatcgggctgtagcccgcgggcagggcgccgtcccagagcgtggtgagcgcgccggactgggcgttgctgcccttgatggcgaaccgggaggtcccgttgttcttcagcatcgcggtgacgaatctgctcgggaaggcccgctgatggggattccaggtccggctgccaccggggtacaacccgtattcgaggtcggcctggacccacggcccggtgccggagcagccaccgaaccagcagctcgtaccgaagtagatggcgtccatcgcgccggcgccgtcggcccgccgggtggtctcgctgttgccgtagtcgaagcagcagcccccgttgacgtgcgtgccgctggtgaccaggtagatgccctcgggggcgctgccggtcgggatcccggacgccgacccgttgcgccagtagctgttgcccgcgttgatgtagagcgagtagaccctgctgccgccgaccgtgaccgcctcccgggtggcgccggccgcggtgtccgcgccgccgattccgccggtcccctggtagcccaggttgttgccgtgccccgactggtcgtagaggacggtgatcacgcaggacgtgcccgcgcagaaggtgtcctgcgccgccgcgtcggccgggccgccccggctgaccacaccgatgtcccgggtggcgtggtccgacgcgcgccggacctgatagagcgcgccgttgtaggtgctgagcagggcgcgggtggtgctgtgcgccgccacgcagggggtgccgcccgcggcgtacaggtcacagggcagcccgccgggtgacgtcgggggcgaggccgacggtgacgccgaaggtgaggtcgagatcgacgggacggtcccggtgcaggtcgtgccgttgagggcgaacgacgccggcgccgggttgctgccgctccaggcgccgttgaacccgaacgacgcggttccgccggtggcgatcgtgccgttgtagctcgcgttggtgacggtgacctgggcgccggactggctgaccgtgccgttccagagctgggtgacgctctgcccggccgggaaggtccaggtcagctgccaggcggtgaccgggtcgccgaggtcggtgacggtcaccgaggccccgaagccgccctgccacgagttggtgacctgatagtcggcgcggcacccggccgccgcccgcgccggcgtcgccgccgtcaccgcgacggcgccggccgcgccggccaggatgatgccgaggagaacgggcatgcccttcaccgggcctcctttttagagaatggcggggtacggggtgggagcccggtccgtcccctcggtttccgggctcccacgccgtgggcgaaccgccgggtcagggagtccagggggtgctgaccacccagctgacgtcgtcggtccacgaggtggcggaatcgaacgcgttcgtgccgccgttgctggcgatgtagacgttgttcgcgtagtgccggatgaaccggtccgggtagttgaccgaggcgaacgagttgccctgcccgttgcggccggcctgcgggcagaacgtggcgtcctggctgaacagcgcgctgccgtcgttggcggccagtgtcagctggtagttgcggtgccgcaggtagttccccgaggtgttgcgcgactcgaacgagacgcaggagctgttggccaggccggcccggacgatccaggaggcgttggccttgtcggccgcggcgctgccggaggtcaccacggcggtgttgaccgtgctgccgctgtgcgagatgtagcgggtcgtgcagcacgcggtggtggcgcgcagcgagatggtcgaacccggggtgatcaccgggccacccccggagccggaggtcgcgtacccggccgcggcgatgttggcctggaccgcgttctcggtggcgtccgacgggtagccggaggtcatcacgccctcgtagaaggtgccggccgcgccgtggctgttgtccccgccgatgcccaggatgatggcgccctccttcttcatcgggttgtagccggacgcgttcggccggctcccgttgtagtaggtggacaggccgccggactgcgcgttgccggcgcggatcgcccagtggttgggctcgcctttgatgatcgcggtcaggaagcggtggctgacgctcgggtcgttcgcgttgtagccggggttggcgccggagaacaagccgttctccaggtcggccatcacccacgggccggtgccggtgccgtagccccagaccttgatgttgccgaagtagatggcctccatcgtgccgttgccgttgtcccggctgttgcgctcggcgttgccgtagtcgaagcagcagccgccgttgtaatgggtgccgtcgaagatggcgtacatgccttccggctgatcgccggtggccaccccattggtggtgttgttgcggtatccggtgccgggggcgacgaacacgccgtacgccttgtgcccacccaccgagatcggcgcggtggtcgcattggcgagattgtcgtaaccgccggccgccggcccctggaaactaccgggcggggcctgggtgagccggttgttgcgcccggtctggtcgtagatgacggtgatcaggcaggtgctgccggcgcagaaggagtcctgggcggcggcgtcggccaccccgcccgcggtgagcggcgcgatgtcgcgggtggcgttgtccgacgatcggcgtacctgatagagcggcccggtgtaggcgccgtagagggcccgggtggtgctgtgcgcggcgacgcagggggtgccgccggaggcgtagatgtcgcacggcccggtggtggcggcctgcgccggggcgatgccggtgatcatcgccgcgagcaggccgccgacggcgggcagaatgcctcgcagacgcggtcgtgatgccatgacctctcctttacggggtgccggggaatggcggtggggaacgcgtgtgaacgctaacacgcgcgcaacatcgtcgatatattccagcgccgcggtgacggagaatggcttttcacatgccgtggaaaattggcgtcggcgaattgttacttcgcccggccccgccgggtcacgagccgtcgtcggccgtcttcccggacggtccgtacggcgaggtctgccccgcgggcgtcgcccggttcccggatttgtcgtggctgccgtgcggagcctcggtcgggtgcgcgtcctcggtgcgctgcttggtggtcggggactcgccgctgcgccgcaactccggctgctgaacgttggtcatcgcagtgtccttcctctggcgaatggtccgaagcgccgcatacccaggcactcgccggatatgtccacccgggcggccgggtcatcgcgcggcgctgccggcatccgcgtaccgcagcaccgcaccgatgccgtgctccagcgccacctcctccggcgccaccagcaccaggtccgcgccggtcgccgcgatcgcacgcagcagcccggcgtcggcccgcacccgctgcgggctcggcactcccgcctcccgcaacgggtggtcgtcgaccgagatcagcgtcggatcgtccggcgaaacccacaccgtgtcggtcgacgaggcgtcgtcgaccagcagcacggtgtccacctgcccgcgctgcagccgggtcaccacgtcggtgaggccggcgccggccgtgccgtcgccccgctgggccaggtaccggtcgaccgcctcccgggtgtgccggtcggcgacctcggcgatcgcctggatcgtcacgtcgtccagcggagactcgtccgccccggcgtgccgcgacccggcgtcggtccgcaccacccggtcctgccagcgccggggcagccgccccgcgaacgtctgcaccgcgcgcacgtcaccaccgacgacgatcacctcggcgcccgcgctgtccgccagatcggccgccgcggccgccacgtcaccggcgttacgcttccaggactcctcggcggcctggtggtaacgccggtgcgaccagccgccggcctgcaccttgcgcagcgggaaggtggcgccgccggtcacctcgcggtgccgtgtggccccgccgaccgacagcgcgtccaggtcggcgccggtgcggtcggtcagcacccggacgtacgggatctgttcaccgcgctgcgcgatcagcggcatcaggtgcggcagcgcaccggtgaccgcctcgtcgacgggcggcggagccggcgtcgtctccaccatcgccacctcgccgtcgcgggcgaacaccgccagaccgtaccggcccggctggtacggatgatccttgacggccgcctccacggcgtccagggtggcgctgtcggcgccgtccccggtcagccgctcgcgcagggcgcgccagcgcagcccgacctcgtgatcggcgttctccccggcgcgggtcgcgtccagatagaccgacacccatgagccggtacggtcgacgagcggacggacgaagtcgagtttcatgatgggcacaccttccggtgatcgtggtgcggggcagggtcgtggccgcatacccgtgatcacggtgcgtacgctcgtcagtcgaccgtcacgaccgaggagacgccatggcacatccgccgatcgagccgtacgcgaccggaatgctcgacaccggggacggcaacgccgtgtactgggagacctgcggcaacccggacggcctgcccgcgctggtggtgcacggcgggcccgggtcgggatgctcggtgggcatgcgccggtcgttcgacccgcagcggcaccggatcatcctgttcgaccagcgcaactgcgggcgcagcacgccgcacgccagcgaccccgcggcggacctgagccggaacaccaccgagcatctgatcgccgacatggagcggctgcgggagcacctcggggtgcagaagtggctggtgtccggcggctcgtggggggtcacgctgtccctggcgtacgcgcagcggcaccccgaccgggtcagcgggctgcaactggtcagcgtcaccaccgggcggcggtccgaactgaactggctctaccggggaatcgggcgggtcttcccggaggcgtgggcgcgtttccgcgacttcgccggggctgcggaataccggctgccgaccgacaccgagccgccgatcgaggggctgctcgcgtcgtacgcgcacctgctcgaagatcctgatccgcacgtgcgccagcgggccgcgaccgagtggctggcctgggaggacgcggtcatctcgatggagcacaacggcaagcccggccaatacagcaaccggctcgacgacgcgaaggtcgccttcgtccggatctgctcgcactatttcgccaacggctgcttcctcgacgacgatgtcatcctgcgtgacgcaggcagactcgccggcatccccggtgtcctgatccacggccgtgccgacctcggcagcccggtgctgaccgcgtgggagctcgcccgggcctggcccgacgcggaactgatcgtcatcgaggactccgggcacaccggcagcaccggcatgcaggaggcgctgcacgccgccgccgaccggttgcacgagcggatcaccacgccggtgcgggcatagcgcgggcgagccccgggccgccggcctgcggtacggtgtgggggtaccgctcggtcgcggatcgcccccttcgtcatgcgccgggaaggtccgccatgcagatccgtccgttcgcccgcggtgatcgcgagcaggtcaccgccctggtcaacgcccacgtcgccgccgtcgtgccggggctgtcggtgtccgtgcagaccctgctcagccagctggaacgcgagcccggcgagaccgtggtcgatccgtgggtgacggcgcgggtcacgatcgtcgccgaggaacggcagcgggtggtcgcggccgctcatctgctgcggtacgacggcgccggcgactaccgggacgccggtgagatccgctggctggtgtgtcgtccggagcacgtggacgcgggggacgccctcgcgctggccgggcacgcgctgttccggcggtggggggtggcgcggcgtctggccgacggtgggttgcccgccccgggggtgtacggcgtaccggcgcaatggcctcatgtgcggggaatctatgagcgggccggtttccggcagaccggccgcaccgagaccgtgcacctggcgcgggtcgcggacctggcccggcaggccgtgccgctgcccggcctgaccacccgacgcacggtcggcgggaccggcacccggatcgccgcgctgcgcggtgcggagcagatcggctacatcgaggtggacaccgacctggacggcggaccgcggatgtcccgggccggctgctgggccgacgtcgggaacctgtggatcgagcccgcctgccgccgtcggggggtcggcagctggttgctcgggcaggccgccgactggctggacctgggcgggacgacccggctgctcgactacgccgacgagggggaggacgggtacgccggcttcctgaccgccgttgggttcaccgtcctgaccagcaccggccggcgcttcacggcttgacgcagccggcgacccgcctgccttcgattgggtgaagaccgttcgatcggcgtacgaccggtgccgtccgcctgaagagtggcgagatgatcaagtcccgcttcgtgatcccggccaccgtcctggcgctcaccggcatgctgccggccgccccggcgttcgcctcggcatccgatccgtcctgggagagtgtccaggtcaccggcgtcggtgaggtgtacggagagcccgacctgctgaccgccaacttcggtgtcgagaccaccgcgcccacggtcgccgccgcgctggaccgggccgacaccgccgccacccggatgcgcgacgcgctcctgcgtgccggactgacccgcaccgacctgctgacctccagcgttgacgtcaaccaggcgcgcgacaacgacggcaaggccaccggctacaccgtggaccaggggatcaccgcggaaatccgcgacctgccgaaagccggggcgatcctgtccgcgaccatcgccgccggcggtgacgcggcccggctcaacggcgtctcgttcagcatcgagaacgacagcgcgctgctcgccaccgcgcgcagcagggcgttcgccgacgcgaaggggaaggcggaggcgtacgcgaagcaggccggccggcccctgggccgcgtcgtcaaggtcaccgagtcggccccggacctgccggcccccggcgaccagatccgggcggtcagttccgccatgttccccgccgactcaccggtcccgatcgaacccggccgccagcggctgtcggccaccgtgacggtcgagtggctcttcgccaggaccccggccccgaaggtcgccgcccgagggtgacagcccggtcggacccacggcaagccggcaccggccgcgaagtcgtcagtcgacggcgcggccggtgacacgcgatccgatcacgaccaccgctgtccttgaccggcaccagggtctgcaccgggggatgcgccgggcccggcggcaccgcgccgacggtgaccgggaaggcgacgccgggtcggggaaagtgcggtggccggtcggcggtcaacgccgtccgggcgtcctgaccgaggtgtgggaccgggacgacgtgctcagcaggatcgggtacccgctgccggtcgccgtccggcagccggtcaccgccgactggtccgtcgagcgcaccgcgggcctgcgggttcaggcggccgacgtcctgcgcttcgtcgggccgggccggacggtgcaggtggagccgttcaccctgccggccgggctcgccccggacaccggcatcgccgagatgagcgggatgctgccggacgagcgtgcgggtgagctcaccgagcgggacggtgaggtggtccgtcgcgcgttctgcctggatgccggcgagcagcacgagttctacggttacgtggcgaagcccggtcatctcatcgccgtcacctgcaggtatgacgacccggccgaccgggactgggccgagcgcgtctggcggtcggtgggacggtagcgtctcgggtggcacgaacttgttgcgaggtgccccaccggcgacggcggggagaatctgggaagccggtgtgaatccggcacgggcccgccgcggtgaccggggagccgccgcccacgcgcgtgagcgcagccactggccggccggccgggaaggcgggcggtgaggcgtcgatccgggagtccgaagaccggcctcgcgcccatcggccccctccgggcctgagcagcgggagcctgcccacatgcacgatcaagatcaacttccgatggcgctgtacgacgtgatccaccgccgccgcgacgtccgcgccgagttcaccggtgacccggtgccgccgcccgtgctcgaccgcatcctgaccgccgcacacgccgcccccagtgtcggcctgtcccagccgtgggatttcctgatcgtccgcgaccgcgccctgcgcgaggcgttccacgaacacgtgtgtcacgagcgtgaggtgttcgccgccaccctcgacggcgcggccgccacccgcttcgcccggatcaggatcgacgggatcctggagtccaccctgtccgtcgtcgtcacctacgacccgcggcgcggtggcccggccgtcctgggccgccacgcgatcgccgacgccggcctctactcggtctgcctggccatccagaacctgtggctggccgccaccgccgagaacctgggcgtcggctgggtctccttctaccgcgagccgttcctgcgggatctgctcgggatcccgcccgccgtccgcccggtcgcctggctctgcctcggcccggtcagccgcctgcaggagacccccgacctggaacgccacggctggcgccaccgccgcccgctggccgacgcccgccacgagaaccgctggcgcgcctgctcctgaagtcgcgggcagtggatccgtcgccggcctcaggcgcgcggcccaaaccagggggaccgcctgctcacaccgccgggcggggcgccccgcccggcgtgacccgggcggccaggaacttcggggcctgctcgccgtagctgtcggtgagcaactcggcgatctcgtcccagtcggtgtgctccccgaggaccgcggccgcgacgttggccccccagggggcgcgcaagtacggaaagcccgccgcggtcaggccgagcagatccgcggcgggcacccggaacgtgatcacggtcggcgcctcgccgccgacggcatgccgcgcataggccgggttgcgctccaggtcgggcacgtagacgtgcgcgaccgtccggctgcggacccgccagcggaccccgatccaggccggctcctcatacgtctcgggcagcccccggcagatcgcccgcagccgcccgagaatctccggtggcacgtctgcgggctcggacatggacccgaccctatccgagcccggcaccggtctgcgcgcaccgcgcctgctggaacgcctggttaccggcgaggaacttctcaaccggagggcacccagccggacatgcttggattgctggtcatggccccacctttgcagcgccgtgccggaaatcccggatcgcgcatcctgagcgtcgcctcgtatcgcccgcgcaccgaggtgggcaacgaggcgatcgccgccctgatcgactcgagcgacgagtggatccgccgccgctgtggcatcgagtcgcgccgccgcgccgctcccgacgaggacctggtcatgatggccgcggcggccgcttccaaggccctggccggcgcgggcgtcgatccgtgcgacgtgtcggccgtcctggtggcgacgatgtcccaccgcggccgcgcggccaccgtggcacccctggtcgccgacgcgctgggagccaccccggcggccgcgatggatctggcagcggcctgcgccggattcccgtacgcgctggcgaccgccgacgcgctcgtccgcagcggctccgccggctacgtggtcctggtcggcgccgaacgcatgaccgacatcgtcgacgagcatgaccgcggcacggcgttcctcttcggcgacggcgcgggcgcggtggtcatcggtccggcgcagacgtgcgggatcggcccggtggtgtggggcgccgacggctccggaagcgcgttgctgcagtacgacgaggcaggcatcctgcgcatggccgggcccgaggtcttccgctgggcgaccgccgtcgttcccgacctggcccggcgcgccctggacgcggcgggcatctcggcggacgaccttgcggcgttcatcccgcaccaggcgaacctgcgcatcatctcggccaccgccaaggcactggaactcggcccgcacgtgcgggtggccaccgacatcacgaccaacggcaacaccggcgcggcctccatcccgcaggccatggcggcactgccggacacgacgggtcccgccctgctcgtcggcttcggcgccggcctctcgtacgccgcgcaggtcgtcaccctgccctgacccgcggtcgcgagtccaccggcgtccgccggagtcactgggtcttctggaaggcgtcgagccggcggtgcacctcggcgtccacgtccacgaacaccaggcggacgtcgccgggttcgtcgctgccgcgcacgtgacagttgatgtccgcggggccgtccggcagcagcatctccagggtgaccgactggccgggggccagcccgtccaccatgtcgatcagcgcttcctcgccgaggtcgtcgacgtcgagatcgacgatgacgcgtgccccgcccagggacaggtcgatcgccagaccggggaacatctgacccgacggcaggatcagcacgaccgggacctgcaccgagacgcgccgggagcggcgccggtcgacagcgcccatgttcgtgtccacccgcatgtacacgccgggcacggcgccggcgggcgggggcaccaccgtgccgatgatgctgaagccggcaccgttctgtgtccagagcagggccacgtcgacaccgatcatggcgaacccggtgaggctcagccggagcgtgccgtcgctttcccgcgagacccggcaggtccgggccgggccgccgccgagcgacgcgctggcggtcgcggcggtccacggctgtggttcctcggtggtcttgaccatcgttgtcggatctttctgggcgtgccggtcgcgttccgtcgaatcgtctccacagcgacagtaccgtcgcgatcggcccttcaggtgcaggtcagcacgtcaggccgggcagcggggagagcagccgaccggcccggcacctcgccggcgccgatgcggcggacgggctagccggttccgccagggatcgacaggtcgtcgccgctcacgatgaggcagccgaggatcccggccaggacgctgcgctggcggtgcgtcagggtgttcacgaagaccgcggcgtcgatgtccgcctccgcgcacgcccgggcgatctcgcggaccttgccgtgggtcagcagggtacggcgggagaacggctgggacatgcgccgcgacccgccgggacgccgcttccaccggtcggaggcgccccggcgctggacgtaccgggccaccacccggccaccgcgggcctcgaccagggcggcgatctcgtcgagcgtggtctcgtaccgtttctccctggccgagaacagaccgatgaggacgacgtcggctccgtcgagagggtcgccgaggtcccggtactgcttcacgctgtcatgatcgcttcgggtgcgccggcgggccacaggttttcatcggtgcccgccgcggcgatcgcagcaccctcgtcgtcgacgatctccggccgcggaagcgctctctgccgttaacgctcacattcgtaccgagtccagccggaaaaatgccccttgacatcgccgtaacacccatgaaaatcgatgttaactttcacaaccccgtgatccccggcgacagtggcaggtgactggccgctgccgtccacgtacgcgaaaggtccgtcctcatgctccgaagactgctgaccgtcatggctgcggccgttctcaccgcgaccgcgctggtcgccggccccggcacggccagtgccgccggcaccctcccctgtgacatctacgccggcggcggaaccccctgtgtcgccgcgcacagcaccacccgcgcgctgttcggcgcctacagcggcccgctctaccaggtgaagcgctggtccgacggggcgaccggcaccatcggtgtgctcggcgccggcggctacgcgaacgccgccgcgcaggactcgttctgctccggcacgtactgcacgatcgtcaagatctacgaccagacgtcgaagcacaacgatctgaccatcgcccccggcggcggtgcgaacccgaccgccgaccagggcgcgaacgcggccgcgctgccgatcaccgcgggcggccaccaggtgtacggcatctacctctcggccggcaacggctaccgcaacaacgccaccagcggcgtcgccaccggcagccagccggaggggatgtacatggtcaccgagggcacccacgtcaacgatcggtgctgcttcgactacggcaacgccgagacgaacaacagggacaccggcaacggtgacatggacgcgatcaacttcggcaccgagtgctggttcacgccgtgtgccggtggcccgcgggtccaggccgacctggagaacggcctcttcgccggcggcaacggtgtcaacacgaccaacaccgggcgcggcagcgcgttcgtgacggcgatgctgaagaacaacggcaccacgacgtacgcgatcaaggacggcaacgcgcagtcgggcagcctggcgacccgatacaacggctcgctgcccacccaggcgggctaccagccgatgaccaagcagggcgcgatcatcctgggcatcggcggcgacaacagcaacggctcggtcggctcgttcttcgagggcgtgatgaccagcggttacccgagtgacgccacggagaacgcggtccaggcgaacatcgtcgcggtgggctacaccaagagcgtgaccttcccggtgagcggctccagctaccggctgaccaacgtgaccagcggcaaggtgctggacgcgaccaactgcggcaccgcgaacggcacccccgtgcggcagtggacctcgctgggcaacacctgccagcagtggcggttcaccagcgtcggcgccaaccggtggaccatcaccaacgtcaacgccggcaggaccctggacgcggtcaactgcggccaggcactgggcaccgcggtcgacctgtggcagtcgctgggcaacacctgccagcagtgggcggtcatcccggccggcaacgggaagtacgaactggtcgtcgagaacagcggcatggtgctcgacaaccagaactgcggcaccgccgacggcaccccggcccggctgtggatgtggctgaacaacacctgccagctctggtcgatcacctcctgagcaccgcgacgggccggtcacgggtttccgcggccggcccgtttcacccgctcacggcatggtatccgggatgccatggatcaggacgaagcaccggttctcgcggcgatcgagcagtaccgggacgccggcgacatcaccttcgcgctgcccggccaccggctcggccgcggcatcgacgaacggaccgcgggggtgctgtcccgcggggccttcgcggccgatgtgatcaccgcgaaggaggcggccggcgcggccgagacgttgtacgccgacgcggccggcgcccgcgacgcggtcttcaccacctgcgggtcgagcatctccatgcacaccgcggtgctcgccatgaccggccccggccgcaaggtcctcaccgaccgcaacgtgcacaagtcggtggcggcctcgttgatcctggccggtgccgaaccggtctggctgcgcccgcgctgggatcaccggcggcagatcgcgcacccggccaccaccggggacgtccgggccgccctcgacgccgacccggagatcggtgccgtactgatcatcacgccgaccgagtacgggtgcggggccgacgtcggcggcatcgccgcactctgccgcgagcggggcatcccgctgctggtcgacgaggcctggggcgcccacttcgcctaccacgacggcctgccgacagcggccgtgcgggccggcgccgacctcgtcgtgcagagcctgcacaaggccggcggcggcctctgccaggcctcggtgatcctgctcggcggcgacctggtcgacccggtcgacgtgcggctgcgcctcgacctgatcaccacgaccagcccgtccgcgctgctctacggctcgatcgacggtttccgccggcacatggtggccagcggggagcggatcctcgacgccgccctcgaccgggccgaccggctgcgcgaacggttgcggcagacgcccggcctgaccgtgatggacgcctcgatcgtgcacgaggacggggtggccgagtgggatccgctcaagctgagcgtggacgtgtccgggctcggcatcaccggataccaggcgcgggactggttgcaggcggagaagcggctgaccgtgcagctcggggatgcccgccgggtggtctgctcgctgacgtacgccgacgacgacgccgcgatcgaccgtctcaccgaggcgctggaagagctggcggccaagccaccggccgcggatcggcccgccccgcacctccccgacctggagaagctgaacctggagcaggcgatgggcccgcgggaggcctatttcgcccgcaccgagcaggtcgccgacccggccgggcggatcagcgccgagatgatcagcccctatccgccgggcgtcccggcggtcctgccgggcgagcgcttcaccccggaggtggtcgactatctgcgggccggcctggccgccgggatgaccctgcccgacgccgccgacccgacgctggcgaccttccgcgtcgtggtcactccccggcccggtcccggcgcagcgtgaccacgaaccgggcgccgtcgcggtgctccgggtccagggcgatcgtgccgccgtggaactccgtcaccttcttgcagatggccaggccgatgccggtgcccggataggcgtcgcgctgatgcagccgctgaaagatcacaaagatcttgtcggcgtacgacgcgtcgatcccgatcccgttgtcggtgacggtgaacgcccacaggtcgccgtccggctcgacggtgatctccacccgcggcgtccggtccgggtgccggaacttcaccgcgttgctgatcaggttctgccacagcatgctcagcaacgtgctgtcgccgggcacggtcggcagctgtggccggacgatctgcgccccggtctcgccgatggtgatcgccagcgcgtcctcggcccggtccagcaccgtgttcaggtcgatcggctcccacccgtcgtagacccggccgatccgggagaaggtcagcaggtcgttgatcagtcgctgcatccgggtggcgccgtcgaccgcgaactcgacgtacctgcggccacgctcgtccaggatctccccgtaccgccgctgcagcatctggcagaaggaggccaccttgcgcagcggctcctgcaggtcgtgcgaggcgacgtaggcgaactgctccaggtcggcgttcacccggctgagcgtgacctgctgctgccggctctcggcgagcgcgtcggccagccgctcccgcatcgcctccacgtcgtgcccgagcgcgaccacgtcggccggcccgcgcggggtcacccggtgctcgaagtcgccgccggccacccggcgcacctcgccgccgagccgggccagcgggcccagcacgatcagccgcagcagcaccccgatcgccacgatgaacagcaggagcccgccgatcagggtgaggaagacgtcgtcgcggatccggcgcgactcgctcagcgcgtcccgcccggcggcgcgcgccccgaccaggcggttgtccaggtcggtgaggcgggtccggaccgaggtgaacgccgcccgggcccgcacggcgtcgccggtgccggtcgtggccgcctgcatcagcggctcggcgaccgtggcgcgccaggtggcggcctgctcctcgaccgcggtcaggtcggccagcgcggccggctggtcgtcgatcagctcccgcagccgcgcctcgtcctgccgttcggcaccgaccgcctgctgatacgagtcggcgaagtcggtgacgccgctgagcaggaaaccgtgcacggccgcctcctgctcgcgcaacgccccgtcgagctgcaccaccgcggtgcgggccggcgagatccggtcactgagccggttggagaccgcggcggtccggttcagcaggtgcgcgccgaccaccgaggcgcccagcaccagcacgaccatggcgaccaggacggaggcgaaccagcgctgcgtattccacacaccggcacggtagatcacattcgattttcgggaaaatcgtcaggttcgcccggcacccgccgatgcaccccgacgcgtcatcggagggaaggaactcaatcgtggagattgcacagcccggccgcggtgcccggcgactcggtttcgggatcgcggcggcactgctcacgaccgggctcatgggaaccgggccggcacacgccgccacgccggtgccgccacccggccccggttggctcgacgccggcggtgcgaacgtcgccgtcccggtgatcaaggacgcggccggcgccaagctgaagaccaccaaggtcgacacggcaagcctgaccggtgccgggatcggcgttgcgctgatcgactccggagtcgcgccggtgcccggactgagccagcccggcaaggtcatcaacgggccggacctctcgttcgagtcgcagaccccgggcctggagcacctggacacctacggccacggcacccacatggccgggatcatcgccggttcggacccggccaacgggttcgagggcatcgcccccgggtcgcacctgatcagcctcaagaccgcggccgccgacggtgcggtcgacgtctcgcaggtgatcgcggcgatcgactgggtggtcacgcaccgcaacgaccccggcatgaacatccgggtgatcaacctgtccttcggcaccgactcggtccagcccgagctcgtcgacccgctgtcctacgcggtggagtccgcctggcggcagggcatcgtcgtggtgaccagcagcggcaacgacggcgcggcccggatgaccatgccggccgccaacccgtacgtgatctcggtcggcgccgcggacaccaacggcaccgccgaccggtccgacgacaccgtcgcctcgttcagcaaccgcggcaccgccacccggcacccggacctggtggccaccggccgttcagtcgtgtcgctgcgcgatcccggctcgtacatcgacaccacgtacccgacggcccgcgtcggcgaccgattcttccgcggcagcggcacctcgcaggccgccgcggtggtctccggttcggtcgccctgcttctgcagcagcgcccggcgctcaccccggaccaggtcaagcgcctgctcatgcagaccgccgacccgctggcggtggccgacccgatcggcggcggcgccggtcagctggacgtcgccggagcggccgccgccgacgtgccgcgcaccgcggacgtcacccaggcctggccggccgcgaccgggctgggctcgctggaagcctcccggggcaccgcccacgtcgtggacggcgtcaccggcctcgcgctcaccggcgagcgggacatcttcggcatgccctgggtaccggcgacctgggcggcgaccgcccggatcggtagggcgtggaccggcggcacctggaacggcgcggtctggaccggcaccggcttcgtcggtagcacctggccggtgaccacctggaccgggcggtcctgggcgggccgctcctgggccggctcggactgggccgggcgctcctgggccggcggcacctggaccggccgttcgtgggccggcggcacctgggccggacggtcctgggccggtcgcagctgggcctgatgcccgacttgtctcaaccttccgggcggacggccgactggtaggacgacggcgagaggaggaccgatggcgaaaaggcggcgactgacgccgaacgctgcggtcctcaccctcgtcgcggtcctcaccatcgtggtcgccttcggagaggccgccgcctggctgctgttcggcccacccacccccggcggcctgcacgtcccgctgctgatcaccctgaccgtgctgttcgccctggtggaacgcttcaccgtcaccttcccggtgcgccgcggcgcgcacgcgatgacgctgagcgaaatccccctggtgctcggcctgttcctggtcccgccggtgctgttgatcccgatccggctggtcggggcgctcgccggtctgatcctgctgcgcgggcaccggggcggcaagctcgccttcaacaccgcgctgtacctcacccaggccaccgtggccggcgtcgtgttccacctgatccgggccggcaccgcaccgtacggcccggtcgcctggggcgccgccttcgccgccgccttcgccgccgacgtggtgtcgatcgtgctggtcaccgcggtcatcgcggtgcacgacgacagccaggagtggcgccggctgctgaccgccgacgtcaaacaggtcttccagatgccactggtcgcggtcaccaccaccctcgcgctggtcaccgtgctgctggtgcgcgagcaggtcctggccgtgctgctgctcggcgtgctcgccttcgccgcccaacgggtcttccaccggtacgcccagcagagccgcacccaccagcaggtggaggacctctaccggttcgcccagtcactggacggcctgaccggcgccgacgaggtggcccgcgccgtcctcgggcaggtccgtgacctggtccgggccgaggaggcggtcctgatcgtgcccggcccgcagtccgaggtctggacgagcatgcggttgtacgggcgggaccgctaccgggtcgaggcgacccccgccgacgcatggtggctgcccgcccgctccggcaccccggtggtccgggacaccgcgatcgcggtgccgctgcgcctcgacgaatccaccggcgtgctgctggtcaccggccacatgtcggagatccccgcgttcaccgccgaccacgtgctgctgctgcaggcgatgtcctcgcacgccggcgccgccctgtccgccgtccgcctgctggaccggctcacccacctcgcctcccacgacgcgctcaccgacctgcccaaccgccagcgattccaggccgacctgcaggccgccaccgaagcggccggcgcgaccggcggcacggtcggcgtcctgctgatggatctcgatcggttcaaggacgtcaacgacgcgctcggccacgacatcggcgacgacctgctgcgccggatcggccggcggctgcgcgactcgttcgccgggctcggcgtcgtctcccggttcggcggggacgagttcgcgctgctggtgcgcgacgccggcagcgaggcggaactcgtcgcgctggccgaggaggtacgccgtaccgtcgagaagcccgcggccgtcggcgatctgatcctcgcggcgcaggtcagcatcggcgtctgtctcgcgcccgagcacggccgggacgcggcccgcctgctgcgccgcgccgacctggcgatgtacgccgcgaaagcggcgcaggccggcgtgcgcgtctaccgccccgacgacgaccgggacaccgcccgccgtctcaccctgatggccggcctgcgcaccgccgtcgacaaccacgaactgtccgtcgtctaccagccgaaggtcgacccgcgcaccggccgggtgctgggcgccgaggcgctcacccgctggcagcacgacggccgcccggtcccgcctgacgagttcatcccgctcgccgaacgctgcggcctgatcggcccgctcacccggcacgtcctggaaaccgcgctgaccgaatgcgccacctggcgcgccgccggccacgacctcagcgtcgccgtcaacctggcccccggcctgctgtcggtccccgacctgaccgaccgcgtcgaccaggccctgcgccggcacgggctgccaccgtccgcgctcaccctcgagatcaccgagaacggcatcatgtccgaacccgaacacgcccgccgcgccctggacgccctggaccgtctcggcgtcaagctctccatcgacgacttcggcaccggccactcgtccctgggccgcctcgcccacctgccgatccacgaggtgaagatcgacaagagcttcatccgccacatcgacaccgaccgcaaccgtcgcgccgtcaccgacgcggccctgcaactggcccgcgccctggatctgcaggtcgtcgccgaaggcgtcgaggtggaggcggaactggactatctgcgccgcaacggctgcgacgcgatccagggttacctgatctccaagccgatctcggccccggccttcctcgactggctcaccgtcacggtcccgacctcgctggcggtctgaccgttcttgacaccgtcgggcagaatcccaccatggatctcggcgtcagcaggcgtggctacggctacgacagaggcgcggcgaccctctacatgttcggcatcatcctggtgccgttcctgatcttcatgaccctcgccggcgccgtcgtcgccttcgtccccgccgagcaacgccaggacggcggcggcgccatccgcttcctgctcctgctgctgtgcttcggcagcctgctggtcggcggttactccgtgtggttcctgcgcgtcgccggcaccgaccgggtcgcgctgttcacggtcttcgacaacggcctcgcctacggccacgtcgccgaccccttcaccatgcgcctggccgccccgcacagcgtcctgatcccgtggttcgacatcaccgaactccgcgaacgcggccccggttccagcgtgctccgcgccctgctgcccccgggccgccgctaccgcctcgacatcgtcacccgagaccaccgggtgctgaccctcaccggtgccatccagaacgctcgcgaactcgccaccgtcctgcgctcccacgtcggctgagccaccgggaaacccggctgcatggagcaccgtcccctggctaaagtgcgccggtgaacggtgacatcgacagcatggtggccgagcttccgcggatggacagcgtgacgccgatcttgcgggtcgccgcggcgcgtctcgacgacggcgacgcggctttcgtcgccgacctcggcatcgcgctgtggctccggtaccggtgggagaccgccccgccgcaggtcacggaggccttcgagcagctgctccgcctgctgctcgggcggccgggcgtcctcgaccaggccgtccgcctgctgtgcgtcgcgggggaccgccgcacggagcgggttgccgcgtcaatgatcgccgcccggcagcccaccgcggacctgggcgtggtgttccgcgccgatgcgccggcggagttgcgcgcctgcctcgcgcaggagctggtgctgcgcggagccgagatcgaccctcgatgggtcgaccccacccacccgctcggatggcttccgccgtccttgacatctctcgacgcgtctcctgctcttccggtgcaccaggacggccgcgttcacctcgaaacgcccgaactggagggcgagcgcgtgcacgggcacggtggggtgccggagtggcgggagacgacgacctccgaccggtcggccctgctcggcgcggcggtggccggctgggtgcggcgatccaacggccgcatcgaggcgcggacgttcgccttcgaccgggccctgtcgccggacgcggccgccggcgcgctggtgagcatcggcttgcacagcaccgagggaatgacggcgggcctgctcacctgctcgccgtcgcaggcctgggagcggttgttcatcgccgccgcgtacggcgccgcctacgaacccggcgaggcgggagcgtacggccggctgtacgcctggcggtcggtcgccggcctggtcggcgcaccggctgacacgccggtccacgaggtcgcggcggtggcgcacggctgctcctggtattcgttcgccggcgcgacccgctggttcgaggacgtcgtcggggacctcggcctggcggcggtggcaccggaccgtcggggcctggcggtgctcgccgccaccgacaccgactgacggtgctgatcgaccaccccgcgccaccggggtgccgtgcccgatgccctgtacccggtagagcgagaccgccgcccggccggtcccgtcgtcgtagtactccacggtggccccgtcagccgccggccgcatcgccccgcggtcggccgatcccggccggcgggcggcggggcatgcgtgatcccgcagtagaccctgctgagcgtcatcccgcccgtttccactccaccgtctcaccagcgcaccggaccgcgaaaaccccgccgggtcaccatgatcggctcacgcggatttcgctggcagatctccgaaacggccggatcggtgctgatcactcgccggcccggctcttccgctcggcggcgccgacccctcacgatggacggtgacgtgactcgacatcccggaggcgggcatgaccccgatcggcggcgacatccccaagttcctttcggtggtggaatccgccgacgaccgggtccgggtggaggtgaccaacccgcacctggtcaccatcggcgagctgaccgccgagatccgcgacggcaagatcgtcatcaccaccgcgtcggccgatcacctggagttcgtggtcatccggccgtgatccgcggccgccgggtcgcgaccgcgatcacgcccagcgccgtcgcggtccgggccgcgaggacgatgaccgggatgtacgggtcgatgacctcgtgccggctcgcggtgacccggtggccgggcagtgcgtgcggcgtgagatccgggatgagggtgtccggcccccagcgcgccagcgccaccaccccggcgaaggtcagggtcagcgtggtgacggtcgcgatccgccgagcgtcgcgagctcaccgcgagcgcaccgatcaggaggccggcgccgatcaccccgaacgggagctagctagacttcggctcggcatcggccgttcagccgggagccgccacgccgccggcgccggcggccgcggccaccggcgtccactgtcgccggcgcgataccactgccaccagaagatgacgatcaacgccaggtcgatcaggtccccgccgtaatacatcacctcggcgccggtgcgggcctcccgcaggagcaccccggccggcggatgcgcgtacaggaacttggcgagaatcgcgtgcgcggtgaggaacccgatcagggcggccgcccgcaccgcgcgccccggccggtgcggcgccgggtccaccccgacgacagccgccgcgaacaggtagccggcgcccagaatgtggagctgcaccagcccgggatggcgacccgccaggagcccggtgccgtagagcagccacaggccgccggcgtccagcaccgccgcggtcaccggatgggtgaccacccggaccggccggctccgcagtgcccgggccagccgtcgcgcccaccgcgccggcagtgcccggaacgccagcgtgaccggtgcggccagcaccagcagcagcggcgccgccatcccgagtagcaggtgcccggccgcgtgcgcggcgaagtcgtgatgcccggccgcggcgaccggcccgatcagcgcgatgcccgccgcggtcagcccggccagccagcaggcggtccgctcgtccgcccagccccggccgcgccgccgaccggcccggaccgcggccaggtaggcgaccgcggcggcgacgagcagcgccgccgtcatgccgggacgacccggcggcgggagcgcgccagcagcaccacgccggccgcgagcagcaggaccgcgatgatgttccaggcccagtcgtacggcgtcaggttcacgtcgtagcggatctggtgcaggcgcatgagcttgtgctgcaccgtgccgtcgtacagctggaaggcccccgtcccggtgagcagcccgccccaccacgatcgccggtcgaacgccgcgcgccgacgcaggtcggcgagcaggaacagcgccgccacggtgcagaaccagctggccgcgtggaacagcccgtcggacaccagcccgaccgccggcgtcgaccggtcgtagaagtggtgccagtgcagcagctggtgaaacaccgtctcgtcggcgaatccggcgacacccagtccgagcagcgccccggagagcacggtgcgggacattcagaacctccagtggtaaggggattcccgcattccccccggcccgccggctaatcgtgaggtttattgacgaatgtcactggcctgtgagagcgttctctccagtcgtccccaggagcgtgatcatgccgctgcgcagcgtcgccgtccttgccgccaccatcctctcgctgcccggcgcgctcccggctcacgccgctgccgccgccgcgcccaccacgatcaccgtcgggaacgcacgcttccaggtgctgtcgccgacactgatccgcaccgaatactccgccgacggccgcttcaccgacgcggccaccttcaccgtcgtcggccgcggcgcgttcccgcgggccgccaccgtcgtccgcaggtcgctcgcggacggctggctgaccgtcgacacgggcgctgccacgctgcgatacctggtcggttccgggccgttctcgcaggacaacctggtggtccgcctcaagtccggccagcagcaggtcgacgcggcgccgtgggccggcccgtcgtgcgcgctcggcgtgctgtgtgaggcggagaccctgcgggcgccggccaccgcgaccgaccacggcgggtacaccggaaccgggttcgcggccggtttcggcgccgtcggggacgggctcgcgttcaccaccgcggcgaccacggccgggacctaccaactggacctgcgctacgccaacgcacagggcgccgacggccagaacaccacccgcacgctcagcgtgatcgtcgacaacggcgccgcccagcgggtcaccctgccgccgaccggttcctgggacacctggcaggtcgccaccgccgcgatcaccctcggcgccgggcaccaccagatcgccatcgcgcacaccgcggccgactccggccaggtcaacatcgacagcgtcgcgatcgtccggcccggcgacgcgtaccctccggtgccgacggccaccgcctcaccgtgcgcctacggcagcctgtgcgaagcggacaccggggtgctgaccggtggcgcgaagcatgccgccgaccacaacgggtactccggcgcgggtttcctggccgggctggagcacgccggagcgggcgccgcctacacgatcaccgggatcccggcggccggcgactacacggtgcagctgcggtacgccaacttcgaggccggcagccagccggtccagtcgcggacggtgaccgtcaacgggacgtcggcgaccctgccggcgaccagcggctgggactactggcgcacggtggccatcccggtgcgcctcaaggcgggcaccgacacggtgacgctgggctgcccgaccgacgccagctgcaacatcaacgtggacacgatcgcggtggccgcgacgggcacgccgctgaaggccccgcacgcgccgctcggcggataccgtcgcggtctcgacggggtggacggcggcgcgctgaccgcggcgggactgctgtacgccgacggttgggcgctgctcgacgacagcgcctcggcgcgcgcggtgcccgaacaggacggctacgtcttcgcgtacggcaaggacttcgcccgtggtcttcgcgaactgggcaccctcaccggaccgaccgcgctgctcccggaatgggcgtacggcgtgtggtactcggagtactacgaccggaccgcggccgacttccagcagcggatcgtgccgcgcttcaggtccgagggcgtgccgctggacgtgctgatcgtcgacaccgatttcaagtcgccggacacctggaacgggtgggagatcgacccggccaagttccccgacccgcagggcttcctcgattgggtgcacgggcagggcctgcacctgtcgtacaacatccacccgagcatcaaggacaccgacccgaagtacgcccaggcgcaggcgatcgcccagaacaagatcaagaacggggtgttcgactggggtgacccggaccagctggccgcgtacctgtggctgcacaacgacctgaagcaggacttcgcctggctcgactggtgctgcgacggctcgtactcgtccaaggcgggcgtcaccccggactcgtggatcaaccagcagtacgccggccgctacggtttcgcgttctcccgcggttacggctcgctgcagtccggcggttacagcaacccggccgcggtgcccaccggaccctgggccgagaagcgcaccaccctgcacttcaccggcgacgccatctccgactggcagacgctgcgcttcgaggtcggttacaccccgggcgagtcggcggcgaccgggctggccgcggtcagccacgacatcggcggccacaccggcggcctgcagcagccgggcagcgaaccgggcagcaccagactgcccgacgacctgtacgcccgatgggtgcaactgggcaccttccagccgatcgaccggctgcactccaaccacagcgaccggctgccctggcagtacgggccggacgcggcggcctccgcgaagaagttcctgcagctgcgggaacaactgcgcccctacacctacgccgcggcgcagacggccaaccggaccgggatgccgatcaaccgggcgctctacctcgcctatccggacagcgcggaggcgtacgcgtacgccggctcggaatatctcttcggctccgactacctggtcgcgccggtgacgacggccggcaccaccgcgaccaccacggtctggttcccgcccggcaacacctggaccgattacttcacccatcagacgtacgcggggggaacgaccgcgcagatcaccaccaccctgtccaccatgccggtcttcacgcgcggctgaacggctcggtgccaagcacggtcaacagtctcagcctgctctcgtcctcactgcgcggcgccgcggtgaggacgagcagcgactgcgacccgtcctcggtcagcaacacctgacagtcgacctcgatcgccccgatccgcggatgcagcagcaccttgtgctcctcgaaccggcggccgaccacctgtgcctcccacaaccgggcgaactcgggactgcgggacagcaggtcgcaccatctcgccggcccgcgacgccggacccggcaacccgtgggcggcccgcaatgacgccacctgctccggatagaccgggcgctcccgctccggatgcccaaaccagcgccagatcccgctgcgctccatcccggtgaactccgccgcatcaccgaacagggcccgggccggctcgttctgcaccagggtctcgccgagcgcgttcagcaccagggccggcgtgtccgccaaccggtcgaagatccgcagcaggccgggggccatgtctcttaagtccggcgacgctgtgccgatcactggggccggaaagatgtcccgcagctcgggtcccgaaggatgcgccgatgaagaaggtccttgtcgccgtctcctcctcgctgatctccttcggcaccgccgcgccggccgaggcccggcaggtcgcccggcccgccgtcgccgcggagtcccgctccgcggcgggtacccgggcggcggcatacctgcggtcccaggccttctcccgctccggcctcatcgaacagctgaaggacgacggcttcagcaccggcctcgccgtccacggcgtggacgagcagcacaccgactggaaccagcaggccgcctggatggccatggaatacctggaaacggaggccttctcccggtcggccctcgtcgagcagctggaatacgagggcttcacctcggcccagaccgcgtacggtgtcagggcggcgggactgtagccggcccgcgggccgccgagcacgcctgcacccgccgcgacgccggttcaagccggggatcggggccgatccggataccgacggcgatggcggtggccgcttcgcacgtcgcgactccggaccgtggatcatcgctcctgttccagcgggctgccgggggcgaactcggccaccaggtgatcccacgtggggcgcccgcccagcatcggccatgctcgcgtgcgtccctcggtcagggcgatgcggctcaggttcgcggcgaggcggtgacctgcgtgcgcgatgccgtcgccggtgaaaggatcggtggggccgttccgcagatgtgcgatgcgctgctcatattcccggatggggtggcgttgaacggccgagacccatcgtggatcagcggtgggcgcgaggacgacaacatcgggaacggcgccttcggccagcgccgcggtgagccggtcgtggccgtcgacgaccaggagcgtggccagcccgctgacccaccacaacaggaccggcggcaggattccctcgcggtgctgccgccggtatgccttcacccggtcggcgtcaacggcggacaggcgtcgcagcggcaggatgtctcgagcgtcctccgacggatcgccgtagccgaaccaggtaatgtggccctggtccgggtcgacatcgtgcagacggctccagtgtcccgggaccgtccactccggcatgccccaggcgagtgtccaggagccggcatgcagcgggccgtagaacgcggtccgtaaccaagctgcgtaccggtaggtccagcgtgctgcccaccagcccgattcattgccggcctgccaccgcccgcgggcctgccgagcggtgatcggcggcagcggcgactcgtaccgccctgttcggcaatagtgcacgccgcgatggtgtgcccgctggcggccgagaaggaccacccgatcgccctggcgcaggagaagacgccgtcctgccgtcacctcgacccgcagcccgggccggcggggttccgcgacatggaggttcatggcgacccgatcgttgctccgggtgagcgggtgggggtgcaccccgccatgatccaacggcaccgttcgcggagcaaacgatctccgggagacggacgacagctcgcggaatcagggcaagggaagcgggagactcacccccctgaaggccgccgccccgcaatccctgatcgccgcccgctgacccggcccggcgccggcggacctgaatctggagcaggcgatcaacccgcgcgacgcgttcttcgccgacaccgagcaggtcgccgacccggtcggccgcatctccgcggaaatgatcagccctacccgccgggcgtcccggccgtgctgccgggcgaccgcttcaccgaggccgtcgtaacctatctgcgcgtcggcaaggactccggcatgaccctcccggacgccgcggacccggagctgaaaaccttccgggtggtacgcggtcggcctgcgcgtcgatccccgcggcggggcttcacccgtggtcggccggcgcgtcgttgtcgacgagtgaggacaggcgctcttcctcctgctcgtcagcggtcgcgacgcggaatccgggtatccctcgctcttccggccagcgcagctcctgagaaaggccgttcagcgacgcggccaccctttcgccgatcagtcgtgcgcggctcttcaacggagtccacgaatccgccgtgtcgggagagtggacgatatccgcgatatcgtcgtcctgcagtcgcatctcctgattccggaagtgatcctcgtcgaactgcggcggagtagcgtgacgacagagaccgtcgagattcgaccagggattcagagtcgagaacaggattccacgtgcactcaacggacgtgacggctcgtctccgccgatcgtcagggcgatttcgacggtgatgctctgataatacttgatcagcgtgatgtcatcgccgaacaggaatctcctggcacgcatcaggcactcgcgatcatcaggacttccgcggcgttcgtcgaacagtccgtcaaggtaccggtcgagcgactcccgatacgggaaatcgccgagtgccgccacctctgccaggcgcactacgcagagcgctccatacatccggagctgccgcgtatttcgcatgctgtccagccggggcaatatcatcgcagtttcaccatagctgcaagaatggccatgtggacggtcgccgctacagtcacgccgtggatgttgactggaatgcggagctggtcgaccaactggagtcgcactggcatgctcagcttcggccccggctgaacggactgaccgatgatgagtacttctggcaacccgttcccggttgctggacgctcagtcgccgcggctccgaggagttcgtcctggactatgcccacccgctgaacggccccgcgccggttaccaccatcgcctggcggctcgcgcacctcctcgacgtgttcgggccgccggccacgcctcacttcgagggctcacctgggggccagactgccatgacctacccagggacggccgcggcagcgctacgccaactcgacggggggcacgatgcgtgggtccgcgacctgcgcagtctcggagcgacgggcatcatccgggcgcaaggcgcaatctcaccgcctgagtacgcggaggcgccgatggcaaaactcatcctgcacacccatcgcgaggtcatccaccacggcgccgaaatctgcctgctgcgagatctctaccttgggaaaggtggcctgagcggtctatgaccgcagttctgctgcttcgatccaacggccccgcgcacgggcggccagcagagccagatcgcgaccgtttcacgtccgcgccggcctcacgctcgcggtcggcactgtctcgatcgcatagcggcggaggagcattccggagactgatggcggcgatcggttccgctgtcgccggggctccggatccggtccaagcgcggcgatgcgttcccgggctcgcgccgccaccgtcgcgcggtctgcgcagctcagggcacggtgcgtcatctcgtggaccacgacaatgccggtctgctcggccggctaccgggcggcctcgggaccccaccggccggtcatgtcgtcctcgtggtcgccggtctgttccctgccggtcgcgccggccgtcggcccggtcactgaacgtccgctctcccgaagcagcgcagcgcgggcccgcccggcggtggggcagggcgtacgctcgccggatccgcggtcagggctggtagacctcgtcggccttggtgatgtcgccgttggtgacggtgaagacgaacaggcctccgttcgccttgagcgatgtctggaacttgccgaggtcggcggtcaccagatgaacggggccgtggctcatgtcgatcaccctcagcggcgcgccggacttgacgtgcagggtccggagcttgtggctgttgttgcggtagtagtaccccacgcaccagtcgttggcggtctccgtcactccgtcctgcttgcatgccgacttcgcggcggcgccctcgaaccagtcgacgagatcgaaggtgatcgtgtgtttggcgggatcgaccgcggtcaggaacgcgtggtgggtgccggtgagcgccgcggtggtggtgccgcccgcttgcgccgagccggcggaaccatgaccggaggccggctgcgtcttcgcggccgggatcaccttcgtcgcggtggccgcgctcgacgaagcacccggctccggtgtcgctgccgcgccggtcacctgtccacatgccgccagcggggcgagcaccagggggatgaggaggaaacgtcggaacacagggctctccaggtcggtcgtcgtcacgtggacgacctcatgctgcggccccggcgagcccgcggcgggcggcgcgggccggaagtggcacgaaggcgggaccaggcaccgcgacaccgcggggcgacctcgcgcatcgaccgaacgggcgcccaccgggtcaccacgtggtgaggatcagatggttgaccaggagggcggtggcggcctgcaggcacatccagaagcgacggtcgcgcaggggcagcaggacggcggcggccgggagccagacggcgaacggcagccagatgcgttcggtttcggccttgctcaggccggagatgtcggcggccagggcggccgccagcccgcccaggcacagccacgccgccggcccccgggcggcacggagcgcaagggcggcgcggcgcagcatgggtgccgcggccgggccggcgacgcaggccagggaggccaggttcgcccagatccagtaggcgtacgggcgggcggtcgcgatcccctggtagtagcggatcttgaccaggtggtagccctcccaccaggcgaaaccgtaaccggtcagggcggcgacgaccgcggccgcgccgaggatcggccagatcagcagcggccacctgcggtggcggcccacgagcagggtcgcggccggcaggaccagcaggacgaggccgtacgacaggtaggcgcaccaggcgagcaacgccccgcccagcagcagacgccggcgggacggccgggcgaggccggccgcgagcagcgccacggcggtggccccgatcccggcgaacatgccgtcggcggaaacgccgatccacaccgcgcccgggaacagcaccaggaaggggaccgcggcccgggcagcggtttccgcaccgtcggagtcgagggagcgcagcgtgctcgggacggccaccgtgatcaggcaaccgaccaggatgcacaccgtggccgcccaggcacccccgcccagcccgatccggtccagccagacgaaggtcagcagcacacccggcgggtgcccggacacgtgctcggcccagtggtccggcgagttgagcaggatgtggctggtgaagccgcgcagcatggccgggatgtcggtgacccgcggcacctcgctcaggtattcgaactgcgtggtcaaccgcccggccaccccccgctgccagccgtcgatcagcgcgagggagaacgtccaggcgaccgcggccagccaggcgccgaccagcagccgccgccacggcagggtcgccgccagggccggcccccagcggatcaccgcgatcgcgacggccagggcgagcggcgttcccggcccgatgtgcggccgcacgtgcccgaagatcggcgcggccggcgcgagcacgggatgccccgccccgccgagtgccgccccgaccaccgcggccgccgcgaccaggccgagcaccccggcgagcgcccaccgatcgccccgcggaagaccatggagacggaccggcccggaagtcagccgcgcagcggggcgcacgcgaactccttcaagccgacagacggcaggacggccgcccggaagtccagctccgcagccgcccgggccggcgacgccaccacatggcgcacgtccccgagccggaactcgccggtcaccaccggccccggcccgccgaaggcctcggacagcgcggcagccaccgcgccgatggtgatcggatgccccgaggcgatgttgtacgcccggaatcccggccgctccgcccgcaacgccgccacgttcgccgccgccacgtcaccgacgtggacgaagtcgcgccgctgcccgccgtcctcgaacacccgcggcgcccggccgccctccagcgccgaccggaacatcgccgccaccccgctgtacggcgtgtccttcggcatccccggcccgtatacgttgtgataccgcagcgccgccaccgaagcgccgcactcccgcgcccacaccccggccagcagttcctggctgagtttggtcaccgcgtacacgctgcgcggatccatcacggcgtcctcgccgaccagcccgtccagcagcggccggccgcatcgcgggcaggacggctcgaaccggccggcggccagatccccggccgcccgcggtgcggggctcaccggtccgtgcgtcgtgcacgagtaggcgccctccccgtacaccaccatggagctggccagcaccagccgccggaccccggccgccgccatcgccgcgagcagcaccgcggtgcccaggtcgttgctgcccacgtagtccggcaggtcctgcggcccgaccccgagcccgaccagcgccgcatggtgcaccacggcgtccaccccgcgcagtgcggcccgcaccgcttccgggtcccggacgtcggcccggtgcagccgcaccccggccggcacctcgccgggaccactgtccagcacggatacgtcatggtctgccgccagcagcgctgcggtcacgtgggagccgatgaacccggccccgccggtcacgagaatgtgcgtcacggcagcgacgctaggtccgcgagccgccgttgacaccggcccgcgccgatccgtcagcggttcgtaagaactgtcggcgacgtccgcacttcgtaagatttccgggccctgaccagcgctaactttccggccatgaccgatgtggtgctgccctgcctgaacgaggccccggccctgccgtggctgctggaccggatgccgcccggcttccgcgcgatcgtcgccgacaacgggtcgaccgacggctccgcggacgtggcccgccggctcggcgcccgggtgatcgacgtgccgcaccccggctacggcgcggccgtgcacgccgggctgctcgccgccgacccggccgacggggtggtgtgcgtgatcgacgcggacggttcgctggatccggccgagctgccgctgctcgccgaccgggtccgcgccggcgagctggacctggcctgcggacgccgccggccgaccgtgcccggcgcgtggccggcccacgcccggctggcgaacgcggtcctggcccaccggatccgccgggacaccggcctgccggtgcacgacatcgccccggcccgggccgcccgccgtgacgcgctgctcgcgctcgacctgcgcgaccggcggttcggctacccgctggaactgctgatcggcgcggcccgggccggctggcgggtggccgagacggacgtctcctaccggccgcgggcggccggcacccgctcgaaggtgaccggctcggtccgcggcacgctgcgcgcggtgcacgacatgcgggcggtgctggcccgatgatccagctgctggtgatggcgaaagccccggtgcccggccgggtcaagacccggctctgcccgccgtgcaccccggagcaggcggcggcgatcgcggccgccgcgctggccgacaccctggccacggcgtccacgctgccggcccggcggcacacgctggtgctcgacggggaatacccggtcccgccgggctgggcgtgtgtccggcagcgcggcgacggcctgggggagcggctggcgaacgcgttcgccgacaccgcgctgcccggcgtcccggccctgttgatcggcatggacaccccgcaactgaccgctgccctgctgcgggccgcggccacgaggttgcgcaacgagggcgcggtgctcggcccggcccgcgacggcggctggtgggccctcggcttaccgattgcggcgtacgccacggtcctgcccgccgtgcccatgtccaccgccgagaccggcgagctgaccctggccgccctgcgcgcccgcggcgtcgaacccaccctgctcccgacgctgcgcgatgtcgacaccgccgcggacgccaccctggtcgccgccctgtgcccgcccggcagccgcttccccgccgccgtcaccacggcgggcctcaccgcggtgggcctcaccgcggcgggcctcaccaacgcgggcctcaccgcggcccccggccgggccgcggcctcccccgccggcgtcggggcggacgacgaactcggcggaagccggatcgcggacggtgcgggatccggcggggaccgggcttgcgctgctacgactggggtgccggcgtgaccgcccccgcgatcgcctgtccaccggccgccctggacatctacgaccgggcgctggcccgggccgcgaccggcgccgggaccacgctgctggtgcgcgacccggccggccggacgaccaggttcgacgccgccgactggtgccgtgaccaccggcccggcgacacccgcctgctcgaccgttgcaccggcgcgaccctggacgtcggttgcgggccgggccggctcaccggcgccctgctgcgccgcggccgggccgccctgggcatcgacgtcactagctagctaggctcgccccggccggccgggtgcacgccgaactcgcggctccggggaccggcagctggtccggcgcggccaccctgcacaccccgggcgagccggccggcgccccgctgcgctgggcccaggtcgccgccgacgacctggccgccgtcgcccgcgaggccggcctgacagtcctcagcacctggaccgaggagggacgatggttcgcctcactgaccggtcggggcgcccggtgaaccggttgccgcgcccgccggagccgctgcgacgtgccgtggcctggctcctggcgccacctgccagcctgcgccgcggccctttccgcccggacgccttctccggcgatcggcgttccaccaggctgaccggccagctcgggctgctgctcggcgccgcgttcgccatctgcttcgtgaccggcctgctcagccacctggcccagcatccgaaccggtggttgccgtggccgcccggccccgccgggctctaccgctgcacgcagggcctgcacgtcgcgaccgggctcgccaccgtcccgttgctcggcctcaaactgtggtcggtctatccgcggctgttccagtggccgccggtccgcggcctcggccacgccgcggagcgcgcctcggtcgccgtcctggtcgtcgccgcgctgttccaggtgctcagcggtgtcctgaacatcgcgcactggtacgccccgatgccgtttttcttcaccaccgcccactactggatggcctggctggccgccggcgccctgctcacccacatcggcgtgcaactcccgatcacccgcgaagcgctccgccgtcgccgcagcgacccggcgatccccgtcggcgccgccgactccggcagccccgtcgactccgtcgactccggcagccccgttgacgcggccatccccggtggcgccgccggccctgtccaccccgccggccctgtccaccccgccggccctgtccaccccgccggccccgtcgactccgccagccccgccggccgcaccgacgccgccgggcgccgtgaggttctggtggccggtgccgtcgcggccggcgtgatcacggtcgccaccctggggcagacggtccggccgctcgccgggatctcgctgctcgcgccacggcgcccgggcaccggcccccagggactgccggtgaacagcaccgccctcggcgccggggttcgcgacgccgccctggaccccggataccggctgaccgtgaccggtttcgatcgcacggtctcgctgagtctgcccgacctgcatgccctcgaactgcacacctcggtcctgccgatcgcctgcgtggagggctggagctccacgggcacctggaccggcgtaccgctgattgatcttcttgcaatgatcgccgtgactccggacgggtgcgaggccgtcgtcgagtccctgcagagcggtggccgctatcggacatcgatcgtgcaggaggggcatctcgccgaccgccggaccctgctcgcgctccgcctcggcggcgaacctctcgccccggatcacggcttcccggcccggctgatcgccccgaaccggcccggcgtgctgcagaccaaatgggtcaaccggatcaccgtgcggagggccggatgagacgtgtgctgatcgctggcggtctgattctcatggcgtacgcggtgggcggcgcactcctggacgaccaggtggacctggccggcatcgcggtgttcggcctggcggttctcatcctgcacgacgtggtcttcctgccactggtgctgctggccggccggctgctgccccggctcaccccgacgctgcggatcatcacgaccgcctggctggccgtgacgatcgtcgcgctgccgctcgtgctcggattcggacgcgaccccggaaatccgacgatcctgcccaggtcgtacggcaccgatctgatcgggatcctgatcgggacggccgtgaccgtcctcgcctgccgtaagggaatcgaaagactctcggacgggcgccgccggcgtccgcctgggtagcctgcggtggtgacccaccaggtgctggtcgtcgacgacgacccgacggtcagcgacgtcgtgcgccgctacctcgaacaggacggctgccacgtgcgactggccgccgacggactgtccgcgctcgccgccgtcgacgcccaacgccccgatctggtcgtgctcgacctgatgctcggcggcctcgacggcctcgaagtgtgccgccgcctgcagcatgaccagcccggactcccggtcgtcatgctcaccgcgctcggcgaggagagcgaccgggtgctcggcctcgaggtcggcgccgacgactacgtgaccaaaccgttcagcccgcgcgaactcaccctgcgggtccggtcggtgctgcgccgcaccgccccggccgccgccccggccccggccctgctgcgcgacggcgacctctagctagctaggcgccgggcagccgctcgcgctcaccgtccgcgaattcgacctgctcgaattcctgctgcgccacccggcccaggcgttctcccgggcgcaactgctcgaccgggtgtggggctggcagttcggcgaccagtccacggtcaccgtgcacgtccggcggctccgggagaaggtcgaagccgacccggcccgcccggcgcggctggtcaccgtgtggggcgtcggctaccgctgggagccggccgccgatgcgtgacatcctgctgatcggcctctactcgctggccgccggcaccgccgtcggcgtgtgcggcgccggcctgctccggctgctccgcggccgatcgatcgccgtgcacgtctgcgtgctgctcggcatcaccatcaccgcggtcgtcgccggggtcaccacggtcgcccgggcgatgttcctgtccgcccacgacatgcaggtcgtgctgctcaccgtcgccgcctcggccctggtcagcctggctttgggcatcgtcttcggccggcgcctggcggccgccgcggtgtgggccgccgaagcccgcgaacgggaacgccggatggaagccggccgccgcgaactcgtcgcctgggtctcccacgacctgcgcaccccgctcgccggcctgcgcgcgatgaccgaggccctgcaggacggtgtcgtcgccgaccgggccggcgtcgccgaataccaccgccggatcgcggccgaaaccgatcggatgagcggcctggtcgacgacctgttcgaactgtcccgcatccacgccggcacgctccggctgaccccggccagcctgcccctgcgggacgtggtctcggacgcggtcgccgcggtcggcccgctcgccgccggccgcggcatccgggtcgtcgccgcctgcgacagctggcccacggtgaccgggggagtggccgaactcaaccggatcgtcagcaacctgctcaccaattcggtccgctacaccccggcgaacggcatcatcgagatctccgccggcggcgacacccgcgaggtgtggttcgccgtctcggacagctgcggcggcatccccgaggaggacctgccccgcctcttcgacgtcgccttccgcggcagccgcgcccgcaccccggacgacggcgcgaccggcgccggcggcggcctcggcctggccatcgtccgcggcctggtcgaagcccacggcggccgggtcggcgcccacaacatcaccggcggttgccgcttcgaggtccgcctgcccgcctgacggctctcggcagccacacagcccgacccggcgaccgggctcctagatgcccgggaagccggtaactttttcaggtgcctcacggtcgatcgtgtccacgccgccggccggcggcggtgaccggtgcgttcgggggtcagctcacgatcgcgcggctgctcctgggcatgatggcggcgaccatgaccgctctggtcctggcggggcaaccggtcgacgatgtggtgtccgcttccgtcggcccggccggagtgttgctcgtcctcgccgtccggctcgcggcctgcgcgttcgggttgcgccgcggcagtcgcatcgcctaccggccgagcctacccgggacgctctgcgcggcaactgacatgcctcacgcccgaaccgtcgagtcacttccgacacgcactactggagtgccgagattagatcacctcgacaggctcctcggttacctcaccgtcccggatcaaaaacgatcggaattggacggcgtcgggatcgcgggtcgacacgataatgtagtgcgcgttcttctcgccggcgaacgcgacagtggttcgtgatgggaaggcttccgtagcggtgtgagagtagtagatcgctaccggctcctcatcgttggcatccatctctcgccagacggcaagctgctggtgcggatcgaactcgtagaatgtcatcgatgcggcggcgttccacatcggaatgaaacgttccggccggttcgaaccgatcgggcccgcgaccaggccgcacgctgtgatgggatgaaccgccaggcaatgcgccacgatgccgtcgaatactgcccggcggattcgcagtccgcctgcgcctgtcttgtacggatgggccggcctcgagccgatggccgggccggcagcgcggtcctgccatgcattctgggtcagcgcaagctggtcgatggtgccggttccccgctggcccgggaccggaagcccccgggccagcatggctgtcagcaggtgccgaaagatttcggcgaacgtgagtaggcggggggcctccggcacgccgttgacgagcagccgcaacagttcacctgtgaaggccgtgtatcgcgcaccgggcggggcgagcgccggggcatttcgttcggtggaggtgagaatgtaggtgccttcgatgccgacctggccgaggaccgtcgctgccgggttgcccgccatgtcctgcacggcgagcccggagaagcaggtgtcgagcacgacgacccggttgcgggctgggctttccctgaccagttggcggaccacgtcgtaggcgatagcgctcaccggcaactcgtctggatgtgtttcgctcagactcaggtaaagctcgttacggtcgccggtgaagccgtggcccgcgaagtagaacagcagggtgtcttcggcgcgggcggcgtattgccgcagtttccggaaaactccgcgcgcgtcgcgcgggttacggacggtgatgcagtgttccgcgggcagccccgtccggtcgggatcggtcaaaacccttcgcagcgcagaaaggttgttctccaccgcgggtaggtcgaggatctcatccgcgtcgtaggaccagacgccgaccaggacggcataggagcgctggggatccggtagacggatcactgcgattccgcgctcgcgtcgagcacttggcggacaagtgcctccgggtccttggtgcgcttcgcgttgacctgtatcttgcggccacccggaccggttatcgtgatcgtcacatcggagcgtcgctgcaggagccagacggagagtgtcctggccagggtggcccacacggcgccggcgctgacagcggcgctgaccacgtattcaatttggccgcccatctcgcccactcgggaaatggcttcccgcctcaccctgccgcgcagttcacgttcattgagcagccagtcccagagggcaattcggtcgttatccgagccattgatcgcgatgcgggcatccacaggcgtccttccctgccgcagaactccggccaaggatcgtagcaaattgcagcacggacgggaaccggctccaccctggcgtgaaagccgtatggaggctgccggaagcgctgctgcaccatgcggcaccggtgccggctcgcaccccgtccgcacaagtcggcggcagaacagtgaccccgggcgggcgcatcccgtcacttcgccgttccccaaccatgatgcctttggtgagacaggccttgaagtcgaagaaatgcggcccgtccaccgagacacctggttggatttcctgcaacgtccaggcgtgatcgatgtaatcgtcgaacacccttcatcggtagatccgagtacgcgcatcgccctcgggacaccgatggtgaccgcctgggcatcgagaggacgacatgatgccggcgctggggaccggtaggccgccggtgacggtgatggggtgggcaacaatcctgcccgaatgccgccggctgcggacgggcagccggtggccggcacgaccgcgcccggctaatctgccgggaacgcgggaggattcgatgagggccgagacaacacgactgcgggccgacgcccagcgcaaccgcgaccagatcgtcgccgtggcccgcgtcgtgttcgccgagatcggcccgggggcgccgatggacgagatcgcccggcgggccggggtcggcgtcggcacactctaccgccgcttccctgaccggggggctctgctgcgcgccgtggccctggagagcctcgcggcggtcctggccgacgcccacgccgcgatcgaggaggagccgaccgcctgggacgccctcacgcggatcgtccgccgggccgtcgacctgcggttcagcacacacgtcaccatgatggacgagcacacgcggcaggccctgcgagaggcacccgacttccggcacacccgcgccgcggtgctcggcgtggtggagcacctggtcgagcgggcccaggccgagggctcgatgcgctccgacgtcggcgccggtgacgtgttcgcggtggtgtctctcctgctcaaaccgccaccgagccggtccgcggagatgtccgacctgctgatgcggcgctgcatgacgctcatcctggacggcctgcactccggcgggcagagcgtgcttcccggcgacccgatcagcgtgaccgacctccacctggattcctgacgacctcgaagccgactctggacgaatgtccggattcggagctattctcggccaggaaacggaggattttattccgcttaaggtcgactgtgaccgatggaggttctcggtgactgctcccgccctgcagaccacccgacgctgcccgtatgcgcccccggacgagcacacccgcatccgggacaccggatccggaatctcccgactcactctgcccagcggccaggtcgcctgggcgctgagccggctcgaacacatccgcgccatgctcaccgatccgcggttcagctcggaccgtcagcatccgaacttcccccggttcacccgcgagcaacccggcttcgacctcatgcgcccatcgatcatccagctggacccgccccagcacggtcccgcccgcaaggccgtggtcggcgagttcaccgtgcgtcgcatggccgccctgcgcccccgcatccagcagatcgtcgacgaccacatcgacgccatgctggcgggtccgcgtcccgccgacctcgtaccggccctcgctctgccggtgccgtcgctggtcatctgcgagcagctcggcgttccgtaccgtgaccacgagttcttccagagccacagttcggccctgctgagccgcgccgtcacggccgagtaccggcggcaggcggccacggagctgcgcgactatctcaaagacctgatcgccgagaaggccgccgacccgcccgacgacctgctgggccgtcagctcgcccagggcaacgaccccgaggacgtgctgtcgctggccttcctgctgctgatcgccggccacgagaccaccgccaacatgatctcgctcggcgtggtgacactgctggagcgcccggcggacctggcggcactgcgcgaggacccggcgcgtacgctccccgcgatcgaggagttgctgcgggtctacaccatcgccgagttcgccaactcccgcgtcgcggtcgaggacgtaccgatcggcggcgtgaccatccgggccggcgaccccgtcctggccctgagcaacgccgccaaccacgatccctcggccttcgacgaggccgaagagatcaagctcgaccggggcgcccgcaaccacgtcgccttcggcttcggcatccaccagtgcctgggccagaacctggctcgcatggagttgcagatcgtcttcgacaccctcctgcgccggatcccgacgctgcggctcgcccaacccgccgaccggctgccctacaaggacgacgccttcatctacggcatccacgaggtgccggtgacctgggaggacgcatgaccacgatcgtggcggacctcgaccgctgcgtcggagcgggccagtgcgtcctgaccgaccccgacgccttcgaccagagcgagcaggacggcaccgtcgtcgtcctgcgggacaccccggcggacgacgaggccgtcgagcgggcacggacagccgtcgacatctgcccgagccgggccctgtccctgacgaattagccgccggcacgccacgcggccgagatcgctcacccggccgcggcccgccggacgccgggccgcggcctccgcgtccggcgaaacggcctggcgggccggtggggcgtgggatcctcgaccccatgcatctgagcccacccctgcggcactggcatccggcccgcgacagcaaacggttgatctccgagttcctgcacacccccagcgagctgatggtgctggccggggtctggctgaccgccgcgccgctgcttttcgaccatcaggcggcggtggtggcgtacgccggttggagtgatgtcctgtcgggccttgccctggtcgtcctggcctatgtgcgcgccgtggatccgttcggcaccgactgggtcaatgcggtgaccgggctggtcgcggtctgggtgatggtctcgccgttcgtgcgggggtacaccggttcgacgacggcgacctggaacgatctgatcaccggcgccgtggtgatcgggttgagtgccgcgagctggcacttccggcgcagcgaagcccgtcgtcaggggatggagccgccggaatgaagcgccgtgtcgcgggtgaccgcgccggatggctgacagcgttcacgagttcatcaccgcgcacaccggcgagctggtccgggagctgaccgactggcaacgccggcagcggcccggccgacctgctcgccggtcggctcggtgccccgttgctgttcttcggtaccgggctgcccgaggaccgctggcacgacagcgacgagcgggtcgcggtcagcatgctgaccgggggagcggccgccctagcgcccttctggagccggctggccgccctgggtcagcagcgccggcgggtcgttgtcgcgtccggttccggcccggaaccggaacgtcttgtgggtgccgtcgcagaacggcttgtccgccgacttgccgcaccggcacagcgcgatcgtggcgcgcgccgggtcgatcacgtcgccgtccggggtgcgcagctcgaagtcgccgcgcacgatcagcgggccgtcctcgtacggggtgatggtcgatgtcatggcgtgcgtgatccccgtttcggcccgccgcaaacgggaattcgagcgcccatgaaactgccgtccccacgcggatccctgtccagcgccctgatcgacaccctcggcggcgtcacccgggacctgaccgccgaaccggacagcgacgaggacctgcagctgtcgctgttcgtctgctacgagctcgcctaccgcggctgggacggcgtcgacgacgcctgggagcacgacccggacctgctccggctgcgcaccgatctggagagccgctacgcggacaccctgcacgccctggtcggcgccccggaaccggccgacccgtcgacggttccggcgcagctggcggcgatcgtcgcggccgacgacggcccgtcgctctccggctatctgcgcggccgggccacccgcgagcagttccgcgagttcgtcgtgcaccgctcgatctaccacctgcgggaggcggacccgcacagctgggcgatcccgcggctgggcggccgggccaaggcggcgctgatcgagatccagctcgacgagtacggcggcggcgtcaccggccggatgcaccaggagctgttcaagcagacgatgagctggttcggcctggacctgggctaccacgcctacctggacgcggtgccggccgcgacgctcgcggtgaacaatctgatgtcgtatttcggcctgcaccgggcccgccgcggcgcggtcctcggccacctggccgcctacgagatgacctcgtcgctgccgaaccggtcgtacggcaacggcctgcgccggctgggcggcgacccggccgcgaccgccttctacgacgagcacgtggaagcggacgcggtgcacgagcagatcgccgcccacgacatgtgcggcacgttcgccctggccgagccggagctggccgggcaggtgctgtggggcgcccgctgcgcgctggccgtcgacaacctctgggccaccgcggtgctcgacgcctgggcggcgggccacacctcgctgcgcgagtgaactcccacagctcgacgacgaccctcagggcgagggccgcggcagcctgacccggccggtcaggccgtcgccggacggtctccgggcgacacgctgaacgcccgcagcatcgccgggatcgtcgtgcccggtgccgcgagcagacgccgttgccggtccgccccggtcccctcacgccggatccggtccagcccggcgacgaccgcgtcgagatcccccgccttgcgcagggccggcgcgatccggtccaccatctcgcccaccaggtcccacgccgggcgcgcccgcccggtgcgcagacagagcagcgtgcctcccatcccgctgcgcgccgcgttcccgtgcgccgcggtcagcagcagatcgctgaccatcggcccctcggtggacgtctccaccagcccgcggaccagcatggcgagcagcaccgcgtcggccggtgccgggcccacgtccgccacccgcacctcgaccgtcggaaacgtccgggacggccgtgcccaccacagctccatgctggcgtccatcatctcgccggccgcgaccagcgccgccaccgtctcctcgacctccgctaccgaccccgcgtgcggccacgggccgagtgccggccagcgccgcaactggacgctgcgccagctggcgtacccggtgtcggctccctcacagagcggcgagttcgccgacagggcctggatcagcggcaggtcggggcgcagtcggttgcacacctcgacggcgtgctccggatcgtcgacgccgacgtgcacgtggcagccgcacagcgccgggtcccgggcgaccgggccgtagaagtcggtgatcgcccggaaccgcgggtcgtcgtccggttcccggtccggctcggcgaccgggctggcgccgaccgcgaccagcaggacccccgcggtggcggccgccgcgccggccgcgccccggttctgggccagttgccgggccaggtcgtcggcctcgacgcagacgtccgagaccatctccagcatgctgggccggaattcgcggcggctgcgccgacgcagcgactccggcagcgcggccaccacccgaccggccaccggcaggttgaccccggtggccgggtcgagcaggaggaactcctcctcgaccccgaccgtcctcaccatgggcgggtggcggtcagcagcaccaccgcgatccgttcggcgtgcgcgtaggccgggccgtccagctcctcgccgtacacgtccggatcgacctcccggtacgtccaggtcaggtcggttccggacagccgttcggcggcggcggtgtgcagcgggtcccggccgccgacgatcccggtgccgctgaacagcaccagcgcgccgcccggggcgagccgtttggcggccgcgtcgacgatccgcaggctcaggtcgttgccgtcggcgccaccaccgtcgcggtaggtgcgcccggccgggtcgaccatgaacggcgggttcgacacgatcaggtcgaggtcgccgtcgacgtggtcgagcaggtcgctgcgccgcggcgtgaccccgggggtgccggcgaggcgggcgttgatctgcgcgtaccgcagcgccgtgtcgttgatgtcgaccgccaggacctcggccccgggcgcccgcttcgcgatcgtgatcgcgcccgcgccggtgccgcaaccgatgtccaccgccctggccaccggttccgcccggctttccaggtgggcggcgacggcgtccgccatgcggtaggtgtccgggccgaagaacaccgagtccgccgcgtcggtcggaaaggcggagtgcaggaacagatcgccgtcgtacgtcgagaaccgcacccggctgcgcagcagttccccatccgcctcgacggcgtcggccgcccgcagcagctccagcaggccggccggcagcaccgcgggccggaacggccggctccagccgaacacgtcccgcaggtcgtgcgcctccgcgttggccggccgcgcgttgacccgcgcgtgggtggccggcgtgaccgtggtgaactcgtagccggccgctttcagcgcctgcccgagttccagcagtgcggtcacgatccggagcccggctcggccatccgccggtgcatctcggccttggcgctgtccggcatcaccttgctggccaccgcctgcgcccgggtcttcagcgagccggcgttcaccttctcccgaccctccagcagcgcccggatgccctgttcggcgacctgtgccgggtcgtccttcgggctggatccgacccgggtgtcgtccatctcggcccggtggaagaagtttgtctcggtcggcccgggcatcagcgcggtgaccgtcaccccggtgtccttgagttcggcgcgcaccgcctcggcgaacgactgcacgaacgacttcgacgcgttgtacaccgcctggtaggtgcccggcatcatggacgcgatcgacgaggtgaacagcacccggccggagccgcgggcgaccatcccgggcagtgccagtttggccaggtgcacggtggaggtgacgttcacgtcgatcacgttcagctcatcggccagctcggtgccgccgacgaactctccgccgatgccccggccggcgttgagggccagcacctcgacgtcccggccggtcgcctcgaccgccgcccacgcctgcgccacgccggcccggtcggcaaggtcggcgcggaccgcggtgacctggttacgcccgtcccggcgcaggtcggccgcggcctcctcgatgccctcatcctcggcgatgatcagcaggtcgtagccgtgttcggcgagttgccgggccagttcgtagccgattccactggacgctccggtcaccactgcgaaagtcatgcggcccggatgccctgcgtcgcccgctttatgcgccatcgaccggccgcaatcgcgatcacgacggtgaccagcgcgaacgtgagcaggatgagccgccacgggcggccggaggcgggcaggtcgggcaccgggtattcgatgtacttggcggccgtgacggcggtcgcccggccgtcggtgcgggcgatgtcgcgcaggaccgggtcgaacgccgagtcgccgggccgggccgcggtccgcggcaggaaggtgggggcgccggtcagcgtcgtcgcggtcacgcccggcacgatcagccggtccaggtggggcgcgtcgccgatcggggtggcgaccagccgcaggccgtgtgcggtggtgacgatgcggtggtcgccgaccgggacgacgcgggcggtgaagccgacgccgccgtacagctcggccgccgcggcggtgtctgtttcgggcacgccgtcggtgaggcccaggccgtaggtgggctggaaccagggcagcaccgcgtgcaggccgtacgggtagtcggcgagcgagaggtggcgtccgggaaccggggcgtccgggtagtggaggcgggcggtgatccgggcagcctcggcgggaccggcgtaccggtcgaccaggtgcagggcgccgaggatgccggagctgacgccggccgtggtcagcacgctgccgtcctcgacccagcgggtgccggcgagccaggtggtggccgggtggtcgtggcgcaggccgggcaggtcggcccagaaggatgtggcccggcggccgtcgaggaggccggtcgcggccaggaccttggcgccggagcagacgctcatgaccagaccaccacgacggtgtacgcggttcaccagctcccgcaggggggcctccgccgccgcggcgggatcggtgaacgccgggacgaccacgatctgtggctccggagccgtggccacggcgtagtccgggatcgcgatgaggccgccggagagggcgaccagagcgagcacgatccgcagcaggcgccgcatcatgccaccgccgcccggaacgcccgcggcgacaccccgtaccgatgggtgaaaagccgccgaaaatgccgcggatccgcatatccgcagtcccgcgccacctgctccaccgcccggtccgtggtggccagcggcagctcggcgtgccccatccgtagatcctgttggtactgcagcggtgtcaccccggtcgccgccacgaaggcaccggtcagggtccgcaccgagacgtgcgccaggcgggcgtccgccaggggcaggagcgctccccgaggttgcgggcggtagcgacggagttcgatcggcgggtttaccgggatccgcgtcgggcatgcgggccgtccccttccggaaggatctcccatggtcacccaccgcagcggcgccggcgatgccctggcggcccgcagtccgcttcgtaccgcggccctcgtcgtctccgtcgtctttctgctcgtcggcgtgctcggcttcgtcccgggcgtcaccaccgactacggcgacatgacgttcgccgggcaccactcggacgcgcacctgctcggcgtcttccaggtgtcggtcctgcacaacatcgtccacctgctgttcgggctggccggtctggcgctggcccgcaccgtccccggcgcgcgccggttcctgatcggcggcggcgcgatctacctggtcctctgggtgtacgggctggtcgtcggcgacgacgccgcggccaacgtcgtgccgctcaacaacgccgacgactggctgcacctcggcctcggggtcggcatgatcgctctcggcctgctgctgtcccgccgcgccgagcgctgaccgggctgcccgggaccccgcggggtcccgggctcgcatttccctcgtttcggacatatcgcaccgggtatctcccctctccgcagcgccgggcgctgcatcgggggagtggtccgggcgtccaggcggcgtccggcgtcgacgggggcgtcacgtggtgcaagagatctggccgggcaacagctatccgctgggcgcctcctacgacgggacgggcaccaacttcgcggtgttcagtgaggtcgccgacggggtggagctctgcctgttcgacgacgccggcaccgagacacggcaccggctgtgctcggtggacggcttcgtctggcacgggtacctgcccggcgtcgccgccggcacgcggtacggataccgggtgcacggcccgtacgacccggccgcggggctgcgctgcaacccggcgaagctgctgctcgacccgtacgccaaggccatcgactcggacatcgactgggacgagtcactgttcggataccgcttcgacgatcccgaggcgcgcaacgacctcgacagcggccggcacatgatgaaggcggtggtggtcaacccgtacttcgactggcgcaacgaccggccgccgcgcatcccgtaccaccagacggtgatctacgaggcgcacgtcaagggactcacccggctgcatccgggggtacccgaacacctgcgcggcacctacgccgggctcggccacccggcggtgatcgaacacctgacccggctgggcgtcaccgcggtcgagctgatgccggtgcaccagttcgtgcaggaccaccacctggccgagcggggcctgagcaactactggggctacaacagcatcggcttcttcgctccgcacaacgcgtacgccgcctggggccagcgcggcgagcaggtccaggagttccgggcgatggtgcgcgagctgcacgcggccggcatcgaggtgatcctcgacgtggtctacaaccacaccgccgagggcaaccacatgggcccgacgctgagcttccgcggcctggacaacggcgcctactaccggctcgtcgacgacgatccgcgctattacatggacaccacgggcaccggcaacagcctgctgatgcgcaacccgcacacgctgcagctgatcatggactcgctgcggtactgggtgaccgagatgcacgtcgacggcttccgcttcgacctggccgccacgctggcccggcagttccacgaggtcgacaaactgtcggcgttcttcgacctgatccagcaggacccggtcgtctcccaggtgaagctgatcgccgaaccctgggacatcggcgacggcggctaccaggtgggcaacttcccacctgcctggaccgaatggaacggcaagttccgggacacggtccgcgacttctggcgcggcgaaccggccaccctggcggacttcacctcccggctgaccgggtcggccgacctgtaccaggacgacggccgccggccggtcgcgtcgatcaacttcatcaccgcgcacgacgggttcacgctgcacgacctggtgtcgtacaacgacaagcacaacgaggccaacggcgaggacaacaacgacggcgagagccacaaccggtcctggaactgcggcgtcgaaggaccggccgacgacccggacgtggtggccctgcgggcacgccagcagcgcaacctgctggtcaccctgatgctgtcgcagggggtgccgatgctgctggccggcgacgagttcggccgcacccagggcggcaacaacaacgcctactgccaggacaacgagatctcctgggtcgactggtcgctggccgagtcgaacgcgtccctgctgaccttcacccgccggctgatcatgctgcaacgccggcacccggtcttccgccgccgccggttcctgcgcggcgccccggtgcacgaggccggcgaggcgctgccggacatcgcctggttcacccccgacggtaccgagatggccgacgagcactgggaggccggccacgcccggaccgtcacggtgttcctcaacggcgacgcgatcaccgagcagggccggcgcggcgaacggatcgtggacgactcgttcctgctgatgttcaacgcccaccacgaaccgctgcgcttcaccgcccccgaccccgggttcggcaaggagtgggccgtcgaggtcgacaccgccgacccggccgcggaccacgacgagacgctgacggccgccgagggcgtcgacctgcccggccgcagcatcaaggtcctgcgccgccgcgtctgagccccgggccgggacccgtggccgcgcggggacagcgccccgatgagctcaagcgtctcgatcacggtcgccggctctgccacccgcccaccggatcccgcggccggtgatcgtgcggcgcggcctcctgctcggcggtgaaccgggcgccggtccagcactggacgatcaggtcgtaggcgaccgggtcgcgataagcgtccagggtgtcggcgacgcgtacgtcacagccgtggtcgtgcaggagatccaggaacgagtcggtggtggcggccggctcgtggcccgcccagccgccccggacgatcagcgtgcgcacaccgctcagcctacggccgccagcagggacgcgtcgatgtcggcggccggcgccggccgggcgaagtggaagccctgcgcgtagcggtagccgaggtcgagcagccggtcggcctgctcctgcgtctccacgccctcggccaccgcgcccagcccgagggtggtcgcgatgccgctcagcgacgcggcgatcgcctcctgctgcgggctgccgttgagctcgtcgatgaacgacttgtcgaccttgagggtggtcaccgggcaggtgcgcagcagggtcagcgacgagtgcccggtgccgaagtcgtccagggcgatgccgacgcccaggccgcgcagcgcggtgacggtgtgcagggccgggccgccggcgaacaccgcggtctcggtgatctcgcaggtgacctggtccggagcgaggccgtgccggtcgagcacggcggcgaccagggccggcagttccgggtccagcagctggcgggcggagacgttgacgctgatccgcggtgcggcggcgccgtaccggcgctgccagacggccgcgtcggcgcaggccgtgtcgaggatccaggcgccgagttcgacgatcatgccggtctgctcggcgaccgggatgaactcggccggcgacaccggcttgccgccgtccgggtgccagcggaccagcgcctcgaccgcccgcagggtgcccagcggcaactccacgatcggctggtagaccagccggaactcgccgcgttccaggccgcgacgcagcgcggcggccaggtcggcgtggtgctgggcggaggcgtccaggtcgggcgtgtggtgctggtgccggttggcgccgacccgctgcgcggcctgcagggcgagctcggcccggcgcagcaggtcggggacggcggcaccgcggccgccggccgacccgacggtcaccgtgaccagcaggtcgtgcagcggcgcctggaaggcgtgcagcagcgcggtggccaggtcgtcgccgtccgcgagcgggtggccggccggcagcagcaccccgaactcgtcgccgagcagccgggcgaccagcgccgtaccgcccacggtcagggtgatccgctcggcggcctgccgcaggatcgcgtcgccggtggcgtcaccgagccggtcgttgagggcggcgaaggcgtccaggtcgcagaccgcgacggtggtgtcgccggtgcgcccctgcagggcgtcgacgaacgcccggcggttcggcagtccggtgaggtcgtcgagcctggcctggtcggccagccggacggcgagcacactgttgtcgcgcagcgccgcgtgctgacggacgaggaccagcacgatcagcaccaccgcgccggcggccagcccggccggcaggtagccggtgcgcagcgtcaccgcgagcagcatgatcacggtggcgccgaccgcaacgtacgggacccggctgatcccggcgcggcgggcgacctcgcccggcgcctcccaggtgtcgggggtgtcggagcacgtcaggttggcccgggtctgtgccgcggcggacagggtgatcagcacgcccagcggcagcaccgcggcgaccgtgctgttcaggtgcggccaggaccggaacgcggcggcgagcaccagcgagaccggcccgagcaggccggccggggtgaggaaccagagtgccgcccggggcaccgcgccggcgccggtcagcccggctttgacgatggccagcaccgcggcgctggccaccgcggccacgatcacccgcagcgtggtggccagcggcccgtccggcaccggggacggcagaacgatcaggccctgcaccacgatcatcccggcggcggccgagacgatcgcgatgtccagccagacggcgaccgacgcgcgccggctacggaccgggccgggcagccggaccagggcgaccacggcgagacacaccgcggcggagtacagcgccccggtcagcggacccatcgcgatcacctgcccggggtgctgcaccgcgtcgcgggtctggctgatgacagccagcccgagcagggtgaacgcgatcgacagccggcgccagaagaggcggcacgccccgaccccggtggccgcggcgagcagcgcggcgacgacctgggtggccaccgaggcgaccccgatcggccacagcccccagaccggcaccggcatgcagaccccggcgaccccgaacaccacaccggcgagcaaccacagccccgcggcggcgacgagcagccgcgccgcgcgggtggagcgggacttcaggcgcatcgggcgtgccgttcttctcgcagggcgggtccggaagtcaccatcggcctcgcccggggtggcgtgaggaaaactccgaccgatgtgtcggacctccacccgcggcgctcgcggcatgggaagaacacccatgtgacaggtcaccacccgggccatagggtggcgcacatgtcgcggggacttgcatatctggatctgctcgcccgcgaggccgccctcgtcgagttcgagcggccgctgatcgccgcccgggccgccggtgcccccgccgccgagctcgacgacctggagcaggcgaaactgctcgcgctgcgggtgcgggcactgctcgaacgccgccgccggcgcgaggaggagctgtccgcgctgtacgacacggccggcgacctggccgggctgcgcgacgtcgacgcggtgttgcgggccatcgtgcaccgggcccgcaccctgctgaacgtcgacgtgtcctacatgacgctcaacgaccaagagcgcggcgacacgtacatgcggatcaccgacgggtcggtcgccgccagcttccagaacctccggctgccgcccggcgccggcctgggcgggctggtcgcgctgaccggcaccccgtacgcgacggcgaactacccgaccgacgcccggttcgcgcacaccaccgacatcgacatgggggtcggcgacgagggcctggtcgccatcctcggcgtgccgatgcggctgggctccacggtgatcggcgtgctgttcgccgccaaccgggcggagcggccgttcgcccgcgaggaggtcgcgctgctgctctcgctggccgcgcacgcctcggtggcgctggacaccgcccggctgctcagcgagacgcagaccgcgttggccgaactgtccgcggccaacgccaccatccaggcgcacagcgcgtcggtggaacgggcggccgccgcgcacgaccggatgaccgccctggtgctgcgcggcggcggggtcgacgacgtggccgccgacctggtcgacgtactcagcggcgcgctgctggtgatcgacgcgcacggccgcacgctggccaccgcgcgcacccggggggtcgcggcgaccctgcccgagccggacgggagcacggtggacgaggcggtggcggcgtcgcgcggggagggccgcagcgtacgccgccatgatctggtcatcgcggcggtcgtggccggcgccgacaacctgggcgccctggtcttccgccccgacccgggcccgctcgccgccgccgaccagcggatcctggaacgcgccgcgcaggtcaccgcgctgctgctgctgtttcgccggaccgtcgcggaggccgaggcgcaggtccgcggcgacctgctggacgacctgatcagccggccggtgcgcgacccggacgcggtgcgcgaccgagccggacggctcgggctcgacgtcgacgcgccgtacgtggtggtggtggccggcgaggacaccggcgacgggctgcggcagcgcgcggtctcctgggcgcgcaccttcgccgcggggcggcgcgggctcgcgatgagccgtgacgcccgggtgacgctgatgctgccgggggaggatccggccggcaccgcccggcaggtggcccgcgagctgagccgggcgctggggcggccggtcaccgcgggcggggccggcccggtccgcggcgccacggcggtggcgcccgcgtaccgcgaggccgatcaatgcctgagcgcgctgatcaccctcggccggtccgggaccggcgcgggcaccgaggagctggggtacgtcggtctgctactcggcgagcgccgcgacgtgaccggcttcgtgcacacggtgctcggccccgtcgtcgagtacgacgagcgccgcggcaccgcgctgaccaccacgctggaggtctacttcgactgcggtggcgggctggcccgggcggccgacgcgctgcacgtgcacgtcaacacggtcacgcagcggctggaccgggtggcgcagctgctcggcgacgactggcagcatccccgccgcgtactcgatctgcaattggctcttcgtctgcatcgcctgcgcgcgccgctggcggtcgaccacacctagccgcaggtggatgtgtggatcgctgccatgggctcggtgacgtgcgaggacgtagcgtcccgttacctacgtcacacaccctcgcgctgggaaaggatgcacatgtcgaccaccacacgtgccccgatcgtcaaggtcgtcttcgcttcgctggtcggcacggccgtggagtggtacgacttcttcctctacggatccgccgccgccctggtcttcggcaccctgttcttccccaaatccgacccggtcaccggcaccctgctcgccttcggcacctacgccctgggcttcgcggcccgcccgctcggcggggtcgtcttcggacacttcggcgaccgggtcggccgcaagaggatgctgatcgtctcgctgatgctgatgggcgccgccaccgtcgcgatcggtctgttgcccacttaccctcgcatcggcgtcggcgccccgatcctgctgctcatctgccggctcgcgcagggtttcgcggtcggcggcgaatggggcggcgcggtgctgatggccgccgaacacggcgacgacgcccgccgcggcttctggtcctcgtggccacaggccggtgtggcgctcggcaacctgctcgccaccggcgtgctgtggctgctcgccctggtccagtccgacgaggccttcaagagctggggctggcgcatcccgttcctgctcagcgcggtgctcgtactggtcggcctgtgggtgcggctgagcatcgaggagtccccggtcttccgggaggcgctcgccgcccgggcggaccgaccacaccggccgctgctcgaagtggtccggagatacccgcgggagatcctgctcgcgatgggcatgcggctcgccgagaacatcgggtactacctggtcaccgtcatctcgatcacctacctgaccacgttcgccgggacctccgcggacaagggcaagatcctcaccgcgctgctgatcggctcggccgtccagttcgtgctggtgccgctgctcggcgcgctctccgaccggatcgggcgccgcccgctctacctggccggcgcgatcggcatggcgatctggtcgtacgtcttcttcgggctggtcggcagccgcagcgaaccgcggatcgtgctggcgatcctggtcggcctgatcctgcacagcctgatgtacgccccgcaggccgccttcttcgccgagctgttcggcacgtcggtccgctacaccggcgcgtccgtcggctaccagctcgcctccatcctggccggcgcgctggccccgatcatcgccctcaccctcctcggcgacgtgcaccacccgaacaccacggcggtggccgtctacatgaccgtcgcctcggtgctcaccgtgatcgcggtcctcgccgccaaggagaccgcccgcagttcgctgagccacgatcgcggtttcgaggaggcgccggcgccggcctccccgggggtgccggccggcagcacggtacgggggtccggcagccggtggtagcgtcgcccagtgcgtgacccggacctccgcggcctcctcatcggatacgcggtgagttcggcgggcagcgggatcggcgccggggcactgcccgtcgtcgccatgctcgtcctgcacgcgtcaccgctgcgggtgtcactgctggccgggctcgcgagcctcaccgcggcggcgatcatgctgccgctcggcgcccgcatcgagtaccggcgcaaacgacccgtcatgatcggggcggacgtggtccggctcgtcgcgctcgccagcgtgccgatcgccgacgcggcgcacctgctcacctacccgcagctggtggcggtcggcgtcctcacgacggccgcgacgatcgccttcaccgccgccaccggcacgctcgacggactccgggatccgggcggggtggcgatacatcctcacccatcgcggactgcgggccctgttcggcaacgcgatgctcttcggcggcccggtcgtcatggccgggccgctgctcgcggtgctgatcgtcgacgggctcgggctgccgccgccggcctacgggctggccctgggggtgccgtgcgtcggcgggatcgtcggatcccggctggcaccggtgctggtgcgccgattcgggcagcggcgggtgttgctcgccgccggggtgctgcgcaccccgtggatgctgctgtatccgctcgcgcggcacgggaccgccggtctcgcgatcgtcatggtcgccgacacgctgacgctcacctgcgcgggagtcttcaatccggtgttcgccacctatcggatgaacgtgaccgccgacgcgtacatgacgcgggtacggacggcatggggggtcagcgccaagaccgtgcagccgctgtgcgtcctggccggcggtgggctggccgcactcgtcggtgtgcggaccacgctgttcctcgccgggctggcctgcctggcgagcggcgtgctgctgccgttccgttcactcgccgacgacggggatcaccgggccggcggcgccggtctctcggtcccgcggaggtgtcgtacccccggggcaggatgacttcccgccgggctcgccggccggctggacgggttgctcagcagcggcgctggtcatccgggctgatgtcggcccgaccgggctctccgccttcatcgcctggccgggcaccacgacgaagggaccgaagcagggtccggaatcagccgttagcccacttccggggctgaaccctcctatctttcagggcatgaggatgcaccggcgacacccgacgacggctgccggcctgatcgccgccgccatcgtcagtgccatcgtgtcggcgccgacccgggcggcggccgcggacccgctggtgccggccaccgaccggcaggtgacgttcgtcgtcgacggcaccacgacctacggcaccgtgcacgttccggcgcaccatgccgggaaacgcctgccggccgccctgctgctgcccggcagcggaccgacggaccgtaacggtgaccagctgccggctttccccgtgcacaccctgacccggatcgcggatgtgctggacacccagggcgtcatgtcgttgcggttcgacaagtacgggaccgggcagaccggtctgggcgccttcaccggccgtctcggagagctcgactacccggcgcagctccgccaggccgcggccgcgtacgcactgttgcacggtcagccggaggcggaccggcatgcgatgctgctgttcggtcacagcgaaggcggcctgtcggcgctcctgctcgccgcaacggtgcgtccgcggccgagcggtctggccttactggagccgctggaccaacgcttcctcgaccgggtacgcggtcagcagtggtggaggatcgaccaggctcgcgccgccggcgagatcacgcccgagcaggcgaggcaggacaaggccggggtcgctcgcgtcatctcccagtttcgggccggccggcccgtcgacttcggcggcctggatcccggcctggccgctgaactgaaactgttcgtgaccgggtatgtcgagcggtacatgcggtccatagacgccatcgatcccgcccaggtcgccggcgacctgccgcaccacctgcgcaccctgatcacctgtggcaccgacgacgtgaacgtgccgtgcgagtccaccggtgccctggtcgccaccctgcacaagatcggcagcaccgggccgggcctggttaccctcccctccgtggatcatgagctgcacaccccgggcgctgccgtggacgggccgctggcacctgccgcggtagcggcgatcaccaccttcaccgcccggtggtcgcaccaggagtgctgaccggcgggtcgcgtcacgagcttggtgagcgggcgccgccgggcgggctcaatgctgcgcgtcggccagcagcaagccgaccaggatggccgcggccgccagcgcgagtagcccgacgccgatggtgaccaccgccttgcgccagccgtgcctcggcaccttcaacccggcggcgatcttcgtcgcctgctcgatctcgcccaacggcgtcagcccgctgtgcagggtctggggaaggccagccgtcatccgggaggtggctctaccgtcgaaatccatcccgacagtatgtccctcgaagccggcggccgctggcgaatcggcgagaccgcggcgccggccggtgcggcctcccggatcaaccggtggcgtccgcgccctgccctacaggcagctgaaatagcgcagcgtcaggtcgctcttggtgtgctgcggctcgaccggggtgatgccgtgcgccgcgaggacgtcggtgagccgggccgccacctcgggcgccttgccgaccgggcagcgcgtggacagctccaaaatcgtggagccgtccgggaaggcccaccgctccgcgcacagttgacggtcgaaaccggccggctggaacttctgcttgcggacctcgaccggaccgaggacgaccaggtcgccgagggacaccccgtccggcccgcaggccgacagcagccgccgctgcggctgcgccagcagcttggccaggggacgcccggcggcgacggtgcggctgaccacgtcgcggcccagccggaccttgagcgagccggagcagacccgccgacccggcatcgcgtcgatctcgacctcgagacggttggtgcggcgcagccatttcggcagcgtgtgcgcgcccatcgggcgcagtttgaccaccgcgtcgtccggccggccgccgaggtcgcggatccggacgatcaggccgtgccggtcgagggccaggtcgggcgtgtccaggaagtagacccggcgggtctggccggcgtggcgttccaggtccagcctgcggcaggcgcgctcggtggcgaccaccttcagttcaacgcgttccgcgtcgagggcgaccttgacggtacgaccggagcggtccaccggcggcgtccagagaccccacgtgccgggcgggcgggcatgctggcggccgggtgggcggagccgccgggtgtaggacgcagactgttccgactttcccaccccggccgactccccgttccgctgcgcgctatgcctcctgaacattacctgaggtcgcgggcgggatccggcgtcgcacgtcatcgacggtggcggcgccgggctgccacggagcgacccaggccgcgtccgaggccgggttgaccacaccctcctccaggaacgcgtagcgtccgtcgagcacccgccgggcggccttcacgtccagcgtgtcggtgttgtcccacaaagcggcgaacagcgcctcggcgcgcagccgcgcctgccggcagaagaggtcggccaattccagcccggccggctgccggtccttttccgcgtgggcccgcacgcaggtcgccgacatcgcgaacaattcggcgccgatgtccacgatccggcccaggaagccctgtttacgctccagtttcccctgccaccgggacattgcgtagaacgtggaccgggcgagtttgcgcgatgcccgctccacgtatctcaggtgcgcggcgagcgggccgtaatccgcgtactccatcggattctgcccccggccgaccgccagagtcggcagccaccgggcgtagaacctgccggcgcgcgccccggcgcgggccttgcgggtcaggccggcgtccgggtcgatgatgtccccggcgaccgacaggtgcgcgtcgaccgcctcccgcgcgatcagcaggtgcatgatttcggtcgaaccctcgaagatgcggttgatccgcagatcacgcaggatctgctcggcttccgcgccgcgctcgccgcgggcccgcagcgaatcgcccgtctcgtaaccgcgcccgccgcgaatctggatgagctcgtcggcgatctgccaggccatctcgctggcgaacagtttgaccagcgctgcctcgatccggatgtcgttgcgcgcgtcgtcggcgatcagacagcagagatccaacatcgattccatggcgtacgtcgttgccgcgatgaacgcgatcttcttcgccaccgcctcgtgggtgccgacggcccggccccactgcacccggtccgcggaccattcccggctgatcgccagcgcccgtttcccggcgccgacacacatcgccggaagcgacagccgcccggtgttcagcgtggtcagggcgatccgcagtcccttgccgaggccgccgatcacgttctcctccggcacgaacacgtcgtggaaccgggtgacgctgttctccaggccgcgcaatccgaggaacgcgttgcggcgttcgacggtgatccccggcgcatcgccctccacgacgaaagcggtgatgcccttctccggcacgcgggccatcaccaccagcagggtcgcgaccgtgccgttggtggcccacaatttcaccccgttgagccggaagccgccgtccaccggggtggcggtggtgcccagccgggccgggtcggagccgacatccggctcggtgagcaggaacgccgacacctcgcccgccgccagccggggcaggaacgccttcttctgcgcggccgagccgaacagtttcagcggctgcggcacgccgatcgactggtgcgcggacagcagcgcggcggtcgccccgttcaccgaaccgaccagggtcagcgctttgcagtaatgcaggttggacagcccgagcccgccgtaatccttgtcgatcttcatgccgaacgcgcccagccgccccaattcctggaacacctcgtcgggaatgcgcgcgtcccgttcgatctgcccgccgtccatgtcgtggcggacgtaggcgtcgagtttacggaggaattcgtcggcgtcgggccggtccggcgcggccggccacggatcgatcaggtccagctggaagcggccgagaaacagttccttaccgaaactgggcttgcgccactcggattcgcgggcggcctcggccacctgccgcgcctgcttctccgaaacctctgccggtttcccatccgtcgtggtcatcagaatcccacccctccgacgtcggacgcgctcagccgtcacgctacgccgcggttattacccagcggtaggcctcggtaatgatcgacatcaatggtcgatctagtggtcgccggcccgaatcgccgcggcgaacggctccagcccggcgatcagctcgtccagctcgtccgcgtcgagaacgtcgtacgccggtgccgccagctcgtcggtgacgatctcgatccggtcccggagctgacgccccgcgtcggtgaacccgccggccgcggtcaccaggccacgctcgcgcagcccgtcgaccaccgcggcgagctgcgcgccgggcaggtggtggagccggccgaactccccggcccgcatgccgagggtcagcgcgagcagcacgtgcgcctcggtgccgccgatcccgtgggccagcagggcggcgttgtggccgtcgccgcgatgctcgcgcagcagcgtcccgagatgccacagccgggcgaccggctcccgcggcacggcgagcgccctgagcccggcgtacagcggccggccggcgaccggcgcgctcaacgccgcccgctcggccagctcgttgacccgcggcagcgcgggggagtgggcgagctccccgatcagtccccgcagcgcggcggcactgccccgttcccgcaggaccaacgcctcctccgggctgaccttcccccacacccacggaatgtgccgcgccacctcgccctcggcgaagttgtagaagacggcgtgcaccacctcggccggcgcccgccccagcggcgcggcccggccggcgaagtagccgtcccagtagttgcgcatgccgacggccaggaactcctcgttcgggatcgccgagaaggtcaccgtcccgatcggctcgacgagctcggacatgcggcggatcatgctcaacgggtgtggcatcggtcagctctcctacggtcccggcggtgccgtccggcccgcctctcgcccccgctacgaatgctccgccccgcatccgacaaccgccggccacttctttgtccgaccacccccgggtagcctgcggtcgatggccggatctgatcgtccagggcgggaaacgcaaccgctgacgctgcgggtgatgacgccggagtcgttccggcggcgccgcgccgaaatggtcatgcggtatgccgtggcgggcggcgaagcagcggaggcggccgccgcccgccagatcgacgcggcgctcccgggcggtccggacacccccggggagttgctgcggtcagcctggtccgggccgcacgaggtcggctggatctgggcctcgatgccgggccgggtggtgccggacctggcctggatcgacgaactggtcgtcgacgagggcttccgccggcgcggattcggcgaggcgatcatgcgggcgacggaggccgcgctggcggccggcggcgccacccgggccgccctgaacgtcttcggcggcaacgacggcgcccggcggctgtacgagcggctcggctacacggtcaccctccaggagctcaccgccgtcccgtacgcgtcgccgcccggcccggtcacgctcgtcccactggccggcccggccgcccggatcgaggcgtccgtcgccgcgacagcggcggagttcggcctcggcccggtccaggcccgggagcgggtcatggcccggcagacaccggcgacggtcaacgccgcggtggtggccggcgggcgggcggtcggctgggtctcgtacagtccgcgacacttctcccggccccggtccggcggcatctaccggctcgacatcgacccgccgtaccgatccgtcggctacgggacggccgccgtccgggccgtcctgacggaactcgccggcctgcccggggtcctgacgagcgtgccgcggcccgccgtctggctgcaccggctcggattccggctgtcggcccagcacatggcccacgagctgccgacgggcggaaagcggcgacgccgggccgggtcggcgggtgaatcgtgcacatagggtgtcggcatgtcgctgagccagatcatcctctcgtgcggacgggcgattcagctcaccgagctgcggatgtcttccacctacgcaacgatgctggagggctatccgtgccggcccgtcaacgacatgagagtgagcggcctccggcaacaggccgaacgtgcgtttcccgccacgccggtccacctggttccaccctcccgcgactacccggatcaggcagccggcgccttcggccccgtcgaggtgttgccttccgtggcctgtctcggcgcgttccgctcgacggcgatcgccgccgagctcgaccccgcgctgcaccggtccgccctcatcgtggtctggttccaggccgtcccggatgtcccgtccggagaggacgccgaccctgcgcttcgcggcatccgctgggcggaggtggctgaggactacgagctctaggccgcagtcgtcggggtgagtgaccgctggcgaggcctgtggcgcgaaggtgaaccccgaacatctgcgccgccgtggtgtcgccgccatcgacgcgtggctctgagcgacccacgaagaacggtctaatagcggtcccggcggaccacgtgggcggcgaccaggtcgaggaaggcgcgcagggccggggtcgcagtggggttgccgaggctggccgcggccagggtccagggcgcggccggtgggtccaggtcgatcgcggcgacccggcggccgacctcggcggccagcggcggcaccagggcgacgccgatgccggcctcgacgtaccccggaatggtcgttatgtcgctgacctcgacggcgatcgtgcgggcgatgccggcccggcggaagtcgtggtcggtgcggatgcggttgcagaagccgggtggcaggtcgatgaacggctcgtcggcgagcccggccggggtgaccgtgcccgccccggccagcgggtgcccggccgggacgaggacccgcggctggaaggtggcgatcgggtcgagctgcaggtcggggacgctcgccgtctgcacgccgacgaacgcgacgtcgaggtcgcgggcgcggaccgcggcgagcagcccgtcggtgccgccggcggccatgctcaggctcagccgcacgccgggatgccgggtgcggaagtcgctgaccagggccggcaggtcgatggcggtcaggccggacagggtgccgacgcgcaggctgccggtcagccccgcgcgcaggccggtaaccgtggcgcgggcctggtcgagggcgtcgagcgcccgccgggcctcgggcagcagcgccttgccggccgcggtgagggcgacgcgggtggtgctgcggtcgaacaggggcgcgccgagatgacgttcgagcgcgcggacgctggccgagaccgtcgactggacggcgtgggtgcgctgggcggcccgggtgaagttgagttcctcggcgacggccacgaagtattccagttggcgctgttccacccggccagagtaatcgcctttggcgatggaacgaatcggaactgttcgttggtggcgaacgctgaggcgcggcaggctgtggggcgagacatcggatcgactgaggagctccaccatgaaggtcttcctgaccggcgccaccgggcacatcggctcggcggtcctgcccgccctgctcgccgccggccacaccgtcaccgcgctggtccgttcgccggagaaggccgcccccggcgccgaggtggtcgtcggtgagattcaggaccacgagggggtacgtcgttgggcggccgccgcggacgccgtgatcgccaccgcgtcgccgggtgacgcgtcgagcagcacggtggagacggcgttcgccgaggcggtcctcgacggtctgcggcccggcgccacgttcctgcgcaccggcggcgtctgggtgcacggctcggcgccggacatcaccgaggacaccccgcgcaacgcgccggacctggtcgcctggcgggagaagctcgactcccgggtgctggccgcgcccggcatccggtcgatcctgatcgagccgggtctggtctacggcaaccacgccggcatcccgaacgtggtgttcgccggtgagcgcgccggcgacccgcccgcgctgcgcctggtcggccccggcacccagcactggaccagcatccacgtcgacgacctggccgagctgtacgtggcggccctcgaccgggcggcgagcggctcggtgtatctcggcgtcagcggtgacaacccgacggtccgtgagctgggcgaggccgcgtcccggcggctgggcctcgacggccgggtggtcgccgaggagccggccgcgctggtcgagcggctcggcggattcggcgcggcgctgctgctggaccagcaggccaccggtgcgaaagcgcgtcgcgagctgggctggaagccgtcgcgccggaccctgctcgaggagatcgcggccggcgggtacgacccggcgtaatcggctcgccggcctgccgccacccgcctaccatcgacgaccatgatcgggaactgggtcgacggcgtggaacgggtggcggtgctcaccggtgcggggatctcgacggattccgggatccccgactaccgggggccggccggcgtctggaccctcgatccggcgctggagaaggcgttcacctaccggtcgttcctggccgatccggccgcccgggccgcgttctggcgggcctaccgcgggcacccggcctggcgggcccggccgaacgtggcacaccgcgcgctcgccggcctggaacgctgcggtgtcgcggtgcgcgtgctcacccagaacatcgacggcctgcagcagcgtgccggatccagcccgcgcaaggtgctcgagctgcacggcagcatgcacgaggtggtctgtaccggctgcggcgtgcgcaccccgagcgggccgacgatggcccgggtggaggccggtgacaccgatccgcggtgcaccgcctgcggggcggtgctgaaactggcgatcgtgttcttcggcgaacacctcgacccggacaccaccgggctcgccgagcggatcgccgcgaacgcccagctgatgctggtcgtgggcagttcgctgcgggtcgagccggtcgcctcgctgtgcgcggtcgccgccaacgccggccaccgggtggtgatcgtcaaccgcgatccgaccccgtacgacgacctggccgtcgaggtcatccgcgaaccgatcggcaccgccctgccggagatctgcgccgccctccgcggggcctaggatctcccgatgccgggctcgctcgccggatacgagatcgcccgggttccgttccccggatgaccgggcgacccggagcgggtgatcatcgtgcgtgatcggcggcgcaccgcggtcagcgcgggtcggcgggcgggtcgaaagtcagggtcagccggctgctgtaggcggccgacccgcccggggccggctcggcgtcggccggctcggcgccgtcgagccagaccttcaccgcgcggaacgcgaagccgtcctgatcggccgcctcggcccggaagcggacctgccggccgggcaccagcacgcgctcgccgtccatggcgagggcggagaaatgtacccagcacccgcccggcacatccggaccgtcgatgaccccccagccttcgtccgcgtcgaaaccgcgcaccgaacccacacttgtcatgaggccactgtcccaccggcgccgcaccggggtgaccggttcggtgccgggccgaccaccctgtcgtgggctgccgcccggcgccgggcttcccgggcacgggtctcccgccgatcggatctccggccgatcgcgtcttctcgccgatcgcggcgaagagctcagccgcgggtcaccgggcggggatcgccgccgccgggtcgccgtcggccacctcggcgtcggccggcgccgcaatcgacggtcattgacggctctggctaggctgcgagcgtgatcgagcgggtgcgggttgcggtggtcggggtggggaacaacacctcggcgctggtgcaggggatcaacttctatcgggcgaccgggagcctgaccggtctctgccgcccgcacatcgaggggctcggtgtcggggatgtcgaggtggtcgccgccttcgcgatgtccgacgccaaggtgggcgccgacctgcacgacgcgatcttcgcgccgccgaacaacttcccgcggatcggtggggagctgccgccgtccggggtgaccgtccagcgggggctcaccggtgcggacgggatcgagcggatcgccgaggcggtgcggggcgccgaggtggtgctctattcggcgccgagtggccgggcgggggtggccctcgcgtacgccgaggccgcgctggccgcgaaagcggcgttcgtcaacacgaccgcggatccggtggcccgccacccggagctgctgcaccggttcagcgcggccggtgtgccgctgatcggggacgacctggccagccagttcggcacctcggtgctgcaccacgcgctgctgcggctgctggacgagcgcgggttgacgttggacagctcctatcaggtgaatctgggcggcaccgaggacttccgcaacctggtggacaacccggagagcaagctgcggtcgaagacgaacggcatcggcaccggccgggtggcgatcgcgcccctgggatacctgccgcacctgggggcggagaaggtcgcccacctcaacatcgaggcgcgggggtgggcggggacttcggtgagtgtcgacgtacggctgaaggtcaatgatccgagcggcgccgccggtgtcaacatcgacctggtgcggctggcggccctggtctcgcggcggggccgcgggggtttcccggcggaggcggccgggctgctgaagtcgccgcccgggacggccgtctagaggcgggcttcgacggcgtccagcagcaggtccaacgcggacggataggcgctggtcaccatctcggtggccagtagcggaccggcctcggccaggtgcgggtggctggccgcgggcacgtgaccgtaggtggagcgccacacctcgtcctcggcgcgcaatgcggcgttgggcagggccagcgacgcggcgtcgagggcggcgaaagccagcgtctggtcgatgaagacgtgataggcccggaccgcttcgggcaccgggaggccggcggtccgcaacacgccgagcaccgcctcgtcggcggcgagctcgttggcccggccggtgacccggctggtggtcagcacggcggcctgcgggtgggcgacataggcggcgtggatgcgcaggccgagccggcgcaggtcggggcgccactgtccggtgggacgccagccctccagggcctgcccgatgagggtgtcgccgatcgccagggtgaggtcgtccatgccgcggaaataccggtacagcgtgctggggtcgcagtccagggccaggcccagccggcgggcgctcagggcggcgctgccgtgctctctgagcaggcgtaacgccgtatcgatgatcagttgttcggacagaacgcgaccactgcgggtgggccgccggcgacgccgccgatcctcgctgaccaccgctttcggcatcactcaccccggatctcttatgccaacacggttgaccttacggcacgggaacacgtttgatctgtcccaggggcccctgaacctcattcgtgaaaggcaaggaaggagcaggtcatgcgtgtcctgctggtgggagcaggcggcgtcggcacggcgatcacccggatcgcggcgcggcgcacgttcttcgacgagatggtggtcgccgactacgacctgggccgcgcggaggccgcggtcggttcggtgggtgacccgcggttccgggcggcgcgggtggacgcgtccgaccgggcggccgtcgtcgagctgctcgaccggaccggttgtgacgtcctgctcaacgccaccgacccgcggttcgtgctgtcgctgttcgaggcggcgcaggacgccggcatcacctatctggacatggcgatgtcgctgtcccggccgcacccggaagcgccgtactccaagaccggtgtcaagctcggcgacgcgcagttcgccgagcacccgacgtgggccagcaagggtgcgctggccctggtcgggatgggtgtcgagccgggactgtcggacgtgttcgcccggtatgcggccgacgagctgttcgacgagatcgatgagatcggcgtccgtgacgggggcaacctgaccgtcgacggctacgatttcgcgccctcgttcaacatctggacgaccatcgaggagtgcctcaacccgccggtggtgtgggaggccggccgcggctggttcaccacgcccccgttcagcgagccggaggtgttcgacttccccgaggggatcggcccggtgcagtgcgtcaacgtggagcacgaggaggtgctgctgatcccgcgctgggtcggcgcccgccgggtgaccttcaagtacggcctgggcgaggacttcatccggaccctgcgcacgctgcaccagatcgggctggactccaccgacggcgtgatcgtgcccggcccgaacggcccggtcaccgtctccccgcgcgacgtggtggcggccagtctgcccgacccggccacgctgggcgaccggatgcgcggcaagacctgcgccggcacctgggtgcgcggggtcaaggacggcgagccgcgcgaggtctacctgtaccacgtggtcgacaacgagtggtcgatggccgagtacggcagtcaggccgtggtctggcagaccgcgatcaacccggtggtggcctgcgagctgctggccaccggcgcgtggaccggcgccggcgtgctcgggccggaggcgttcccgcctcgcccgttcctcgacctgctcaccgagtacggctccccgtggggtctgcgtgagcaggcggtgtccgcaccggtgggcgccacggtccactagagatcgacgggtgtgcggcgcggcgtttggtgggaggatcaccccatgaggcggcgttccctcgccgacgtcttcagccggcgttacgacgagttcttccgtgaccgcaccccgattcccttcgagatcctgacccgcgacggcgccaccctcgcctacggcgccggcgggtccactccggccgagttccgcatcgtggtccgtgacgacacgggccacgatgcgctggcctccctggaccagttgcaggtcgctctggcctacctgcgcggagacatcgacatcgagggcgacctcgcggcggcgctgaccatgcgccggttcttctccgacatccatccggtcgccttcgtgggccggtgggccccctcgctgtggcacggcaaggccggccacgaccggcgggccatctcgcagcactacgacgaggagtcggacttcttcctcaccttcctcgacgaacggcaccgctgttacacgcagggcgtcttccacggcgacgacgagcccttggaggacgcggtcacccgcaagctggacatcgccctcgacgacatcggggtgaaaccgggcgaccgggtcctcgaggtcggcggcgggtggggcgcgttctccgagcacgccgcccgtcgcggcatcgacgtcaccacggtcaccctggccgtggagtccgagcggttcctcaaggacctcttcgagcgggaacgtcttccggtcaccgtcgtccgggagcacattctgcagttccgatccgatcagcggtacgacgcgatcgtgaacatgggtgtcaccgagcacctgcccgactacggcgccaccctgaagacgtacgcccggctgctgaaacccggtggccgggtctacctggacgcgttggcgatgcgccgcaagcacaccgcctccaccttcttcaagcagtacgtctatccgggccggtccgccccgctgctgttgcaccagtatctgcagcaggtggcccggtccccgttcgacctgctcagcgtgcaggacgatcggcacaactactatctgacctgccgggagtgggcgaaacgcctggacgcccggcgggaggagatcgtcgcccgctggggtgaggagctctaccgccggttccggatcttcctgtggggctcggcgtccgggttcgacacccggctggtgcaggcctaccggtggacgctgcagtacaacccgtcggcgaccgcctgaccactttcgggcgacggtggctcgcgtcaccctgagcgagccaccgcgccgatccgtccggtcgcgtagtgtcggacgagccgttgtcgcgttcacggccctcgacgatcggagagcgccgtgcccggagccactggactgccgctcgcccccttcctggcgtcccgcgccgacaactacgacgggttgcgcctggtccgcccgtccttcgtgccggagctggtgctgcacctggccgacgacgcgatcgtgctggaggcccggctcgaggcgcaggccggtacgtcgtaccacccgttctggaccaacgcctgggccggcggtcaggcgctggcccgctacgtcctggaccatccgcgcctggtcgccggccggcgggtgctcgacgtcgcctgcggcggcggcgtcgcggcgatcgccgcggccaaggccggcgcggcgagcgtgaccggcaacgacatcgacccgtacgcgtgtgccgcggccgcgatgaacgccgacgcgaaccgggtgcggctggccacggtcgagggtgatctgctcggcggggacgccggtgacgccgaggtcgtgctggtcggggacgccttctacgacagcgccctggccgaccggatgggcgccttcctgcgccgggcggccgatcgcggcgcggagatcctggtcggcgatcccggccgggggcacgtgccggcgtggctgcgggagctgaccacgtaccggatcagtgggctgggcgccgcgcaggacgccgcgatcaccgaggtttcggtgctcggcgtgttacggtgacgctgcgcccaccgggcgtattatttttgcggcaaggagattccgatggccaccggcaccgtcaaatggttcaacagcgacaagggcttcggcttcatcacccaggatgacggcggcccggacgtgttcgcgcacttctccgcgatcgccacctccggcttccgcagcctggaggagaaccagcgggtggagttccaggtcacccagggcaccaagggactgcaggcggagaacatccgcccgctctgacccctgctcagtgggtggccggccgcaccatgtccggccggcccccgctctcaggagttgttgcagatcccggtcatctcgtcgcgcgcgacgaccttgatccgcttgcggccgtgcggctcgcccagcgcgatctcatgcgcgtccagcctctgccagccggcccacgtggtgtacggcagcccgcgctgctccaggtaggcgacgacctcggccggatcgtgctgcggcgccgccggcagcgagtcgaggtccgccaggaggctggccacggtctcgccggcgtcacccttggtgtggccgatcaggccgaccgggccgcgcttgatccagccggtcacgtacatgcccgggatgtggtcgccgtcgaggtccagcacccggccggcggcgtgcgggatggtgccggtcttggtgtcgaacggcaggtccggcagcgcgctgctgaggtagccgaccgcccggtacaccgcctggacgttccagtcggtgaactcgccggtgccgcggacccagccgtcgccggtcagctcctgcgtctcggtgcgcaggccgaccaccctgccgtcctcgccgagcacctcgaccggggcctgcaggaagtacaggtgcaggcggcgcggccggtcccgcgggtcgcggaccgcccagttctgcaggatgtcgacgcacatcttgacgtgccgggtctggcgcatcgcctcgaggctgccctcgtcgaactcgatgccctccgggtggacgatcacctcgacgttcggcgagtggtcgagctcgcgcagctcctgcggggtgaacttgacctgggccgggccgcgccgggagaacaggtgcacgtcggtgaccgggctgcgctcgagcgcctggtacacgttgtccgggatctcggtgaccagcagttcgtcggcggtcttggcgaggatccgggccacgtcgatggcgacgttgccggcgccgatcaccgcgacctccctggcctccagcggccagtcgcgcggtacgtccgggtggccgttgtaccagctcgcgaagtccgcggcaccgtagctgccctgcaggtcgatgcccgggatgtcgagtgaccggtccttctccgcgccggtcgcgatgatcgtcgcgtcgtagaagcggttgagttcctcgggcttgacgtcgatgccgtacgccacgttgccgatgaaccggatgcgcgggttgtccatgatccggaacagcgcggtgatgatctccttgatccgcgggtggtccggcgcgacgccgtagcggatcagcccgtacggcgtgggcagcttgtcgaggatgtcgacggtgacgtccgggttggctttgatgaggtggtcggcggcgtagatgccggccgggccggctccgatgacggcaaccctcagggggcggtccatggtcgcgttccctcgctcactcgtagcaacgaatcccgccccagccaagatcgacctccgggcgaacaggaactctaaaacttcaacctaggttgagatcaagtttcgggttcctggcccggaggtgacctgacggatgttttcgcagctcagagcggcggttaggggaacctaaccaagacgcggagtgaggtgtttcacgattccttgtcccccggaaggaccgcggtctcgccgtagaacttcctgatcttgcgaaccgcggcctcgaaaccgtcgagatccatcggcttggtgacgaacgcgttcgcgtgccgggcatagctcgcggtgatgtccggcagtgcgttcgacgtggtcagcaccaccaccgggatgctcttgagcgcctcgtcgttcttcacctcggcgagcacctcgtgcccgcccatccgcggcatgttgagatccagcaggatcaggtcggggcggcgggcgtccgcatagggcccctggcggcgcaggtagtcgatcgcctcgctgccgtcggagacccggtgcacggccggggccggctccacgtcgagcagcgcctcctcgatcatcagggtgtcggcgtcatcgtcatcgacgatcaggacatccaggacgcgctcggtgtttgccatgcggcaaatactatgggaccccgcaccgtgtcggtcgatcacggtagcctatcgtttccgcagcgcgaaccactgcaacagcaagatcgtcttcgcgtcggcgatctcgccggtcccgatcatctccagcgcctgtccgagggcgagctccaccgccgcgatgtcctccccgtcgtcggccagcccgccacccggccccacccgggacgccgcggtgtacggcgcggcgaaacagtgcagccgctcggtcaccgaccccgggctcgtccacaccgcgaacacccgctccagctcaccgatcgccactcccagctcctcggccgcctcccgccggatcgccgccgccggatcgtccccgtcgagcagcccggccgcggtctccaggaacatcccgtccgggtggccgctcacgtacaccggatagcggaactgccgggtcagcagcaccgtctcccgctcgtcgtcgtagagcagcacggtcgcgccgtccccgcggtcgtacgtctcccgctgctcccggctccacgtgccatccgagcgacggtagtcgtaggtggtgcgacgcagcacgtgccaggcggtcgccaacacctccacgtcccgcaccaccacgtcggggttgccggtcaggtcgcgcccgatccggtcgaggccggtgcggccgcgggcgtccgggatgtcgatgccgggtctcatggacggtaagctacccggcgaaacgcgcaacagtcgacaagaatgaggagaaacacggatgctggcggcggagcgacgcgacgtcctgctgcaccggctgcggaccgacggcaaggtggtggccaaggaggtcgcggccgccctcggcgtccccgaggacacgatccggcgcgacctgcgggagctggccgcggccggtctctgccagcgggtgtacgggggagccctgcccgtgtcgcccgccctggccgactacgcgacccgcaccaccctggccaccttgagcaaacagcgggtggcggccgccgcggccgcgctgatccgacccggttccacgatcctgctcgacggcggcacgacggcgctggcggtgaccgcggccctgcccgccgacctgcgcgcgacgatcgtgacccacagcccgaccgtggcggccgccctggtcgcgcacccggcggtcgacgtccacgtgctgggcgggcggctgttcaagcactccgcggtgacctgcggcgcggccaccgtggcggcggcactcgcggtgaccgccgacatcttcctcctcggcgtcaccggggtccacgaggcggccgggctgaccaccggcgacccggacgaggcggcactgaaacggatcctggcgtcgcgggccgccgagacgtacgtgctggccagctcggagaagatcggtgccgcctcgccgttcacggtgctgcccacgtcggcggtcggcggcatcatcaccgacgccgcggcgtcccaccccaccctgcaggccctccgggccgccgaggtggccatcctcgccgcaccgtgaggcgatcctccccacgcgacgtccgaggcgccatcggaatggcctcgacgccgatccgtcccccgactgtgggacctcttgccgccgactcgaaaatgccgttcacggggcccgtgaagctgtttccggccgggggggtggacggtcggcgtgccgggacgcggcgcggtgcgggcgggaggtggtgaccggtccggggaacaggccgacgctatgctggcgcgggccgatgatgggggcgggattggcgcggacgacggtgcaggatgtggcgcgcgcggccggggtctccgtgtcgacggtgtcgcgggcgctgagcggtgggacggtcagcgcggaaacgcgggagaacgtcatcgaggtggcggcgcggctcgactaccgggtgaatcgggccgcccgggggctgatcaccggtcgtaccggcaatatcgggttgatcgtccccgaccttcggaacccgttcttcgcggatgtggccaaaggggtcagtgcgcgggcccgggccgccgactgcggagtgttcatcaccgacaccgacgaggacccggtggccgagctggaggcgatcgcgacgctcgggcgcaacaccgacggcctgctgctctgctcgccgcgggcggccgacgcggatgttctcgccggcgccgacccggcgacgaccgtggtgctgcaccggcggatcgccgggatgaacgcggtggtcgcggacatcggcgacggcatccggcaggcgctggtgcacctgcaggctctgggacatcggcacatcgcgtacgcggagggacccgccggttcctgggccgcccgcgaaagggttgccgcgctcagcggagcgaagtccctcggccgggtggcgcccaccttcgagggcggtctgctcgccgcggacctgctgctcgccaccaccgccaccgcggtgatcgcctacaacgacctggtcgcgctcggtgtcctgcaccggctcgcggctcgcggggtgagcgttcccgggcagctcagcgtggtcggcttcgacgacgtgagcctggccacgatgagccacccgccactgaccagtgtggccgtgccgaaggaccgggccggcgcgatcggtctcgatctgctgctcgggcgcagcggggtcggcggcgacgtggtcctgccgaccagcctggtggtgcgggcctcgtccggcgtcgttcccacttgatctccacttgccgttagcatgcccgggtgcgacgtagacggggtcttctggccggggcgctgagcctgctcatggtgggtgcgtgctcatcacacccggacccggcgccgcccgccttcgtggccgcgccgggcgcctccggctccgcgctgcccgagtcggcgccggtgttggtggcgccgtcggcggcggtgtcgccgtccccgtccaccgcggtcaagggatcgacgctgccgaaacccgggaatcccgccggccgggccgccgttccggcagcggccaaggcggtcgacacgagccggccggaccgtacgatcggctcgggcaccccggcgagctgcacctccgccgcggtcgtcgccgccgtcgcggccggcgggatcgtcaccttcaactgcggtccggcgccggtcaccatcaccatgaccgccaccgccaaggtgaagaacgcgcacaccgccctggtgctcgacggcggcgacaaggtcaccctcagcggcggcggcaagcggcggatcctctacatgaacacgtgcgaccgggcgcagggctggaccacctcgcactgccaggatcaggacacgccgcgcctgaccgtgcagaacatggcgttcaccggcgggaacagcaccggggaccggaccgagggcggcggcgggggagcgatcttcgtccgcggcgggcacctgaaggtggtcaactcgcggttcaccggcaacaggtgcgaccggaccgggcccgacctgggcggcgccgcgatccgggtgctcgaccagggcggtgacaccccggtgtacgtggtgggcagcacgttcaccggcggcgtctgctccaacgggtcggcgctgagcagcatcggcgtctcctggaccgtgctgaacagctggttctccggcaacgcggcggtcggcaagggcgccaacccggcccgctccggcaccccgggcggcggcagcggcggcgccatctacaacgacggcgaccggatgacgctgaccatcgacggcaccgtcatcgagaacaaccgggccgccgagggcggtggcgccgtcttcttcgtcagcaacgaccgcaccggcacggtggtcatccgcaactcccggttgcacggcaacccgagcgccggcttcgagaccaccggcctgcccggcatcttctacctcggctccggcaacccgaagatctccggctcgaagctgtcctgaccggctaccgccggctcgacttctggttgtcggccgcccggcacgcgcccgggtcagatccagcggttgccgagccacatgcggtcggaccagctgtcgtacgggatgggctggtcggtgaagatcggccagaagtaggcgaagcagaccgcgaccagcaccacgtacgccgcggccagcgcgattcctgcggcccgctgcgccgcgacgatggcgccgaggacgtagacgaccgcgaggatcaggaacggcagggcgggcatcacgtagaacgagaacatcgtgcggtggtcggtggcggcgaaccagaaccacggcaggaggccggccgcggtgacggccaggatggcgtacgcccgccagtcgcgccgggcgacggccagccagatcagggcgatcagggccggtaggaacgaccaccagagcagcggggtgcccagcagcaggatctcgcgggcgcagctgggggcgccgcagccggccggggtggtccagtcgaaggcgaccgggcggcccagcagcagccactgccacggccaggactggtacgggtgcggggtggtcaggttgctgtggaagccgtacgcctccgagtggtagtgccacaggttgagcagggcgccgaggaacggcggctcgcccatgccgttggcggcccgccagtgccggtagaagccgtcgtcggtgaccagccagccggtccagctggccaggtaggtgccgaacgccagcgcgaagctgaacaccccccagccgagatcgccggcgatgccgcggcggatcgggctggtgcggccggcggaacggcgggcctggacccgccagacgacgatcagcagcgcgaacgccggcaggaagaacagggcgctccacttgacggcgcaggccaggccgtacaggacgccggtggccagcagccaccacggcgtgtaccggaacgagccggtctccagcgcgcgcagctgggcgcggcggtagtggtcccggtcgatcaccatggcgccgaacgtggccaggatgaacaggccgaggaagatgtcgagcagcgacgtgcgggacagcaccagctggaagccgtccagggtcatcagcagcccggcggcgccggccagcaccatcgagtggaacatccggtaggcgatccggatcagcagcaggaccatcagggtgccggccagcgcggtcggcagccgccagccgagctcggtgttgccgagcaccttctcgcccgcggcgatcagccatttgcccaggggcggatgaacgacgtaccccgcgctgtcgctcttctcgtcccattcgacaccgtgggtgagcatgtcccaggcgtcggtcggatagtagatctcgtcgaagacgagcttgcgcggctgggtgatcccggtcaggcgcagaatcccggcgaccaccgtgatcaccccggtgaccagccaggagtacgggtcgatccgggtgtccagggtggacagccgccgccggacgatatcgggcaccatcgccgtgatcatccggcgatcttagggtacgggcgaccggttgatccgacctggcgcaccatccgttccttggggaggaggcctgcggaaggagatcgggtgccgggaacgacggttcggtgggtcgtggtgtgcacggcggggttgacggttctgtccgggtgcagtccttccggggacgcgccgccgcggccggtctccggcggggccacggccggtagctcggcggccggtgggtcggcggccgcgaaggccgtcgacgcggcctgtacccgggcggcgaaggtcctgatcgtgcggacggccgccggggaggcgttcagcccggcccggctgaccatcaggcgcggggccttcctggccttcgtgaaccggacgacggccgcgcatccgctgcggtccgcgccggatgccgggatggtcaccagcgtcgtcgacgccgacgagcggcaggtcgtgcagttccccaaggccggcaccttcacggtgcacggcgggggcgcggcgctgcggctcacggtggcgggggagagcgggtgcggcgccccggagccggccctcacgatcaccgccgccgggcggttcacgccggcggcagcggaggtcgccgcgaccgggaacttcgcggtggtgaaccggtccggtgcgccgcaggccttgcgctgcacgccgggggcgaacaacgaccacacccggctggaggccggcgagacgcagatcctggcgttggacgagccggggcggtaccgctgcgccagcgtggagcacccggcggcgtcggtgacgatcaccgtgacggccccggcccgctgagcgacccggtcaggtcaccgccccgagctgccaggggacgaactcgtcgcgacccaggtccaggtcctcgccggcggtcgggcggccggaggcgaccgccaggatcgtctcgaagatctcggcgccggccgcctcgatgctggtggtcccggtgacgatgccgccggtgtcgagatccatgtcgtcgcgcatccgctcgaacgtctcgctgttcgtcgcgatcttgatgaccggcgccggtttgccgccgaggaccgacccgcgtccggtggtgaagcagaccaccgtggcgccgccggcgaccagcccggtcaccgagaccgggtcgtagccgggggtgtccatgaaggcgaagcccggcccgctgatccgctcggcgtactcgtagaccgcggacagcggcgccgcgccgcccttcgcgaccgcgcccagcgacttctccaggatcgtggtcagcccgccggccttgttgcccggtgacgggttgttgtccagggtgccgccgccggcctcgacatacgtgtgccaccaggcgatccggtccagcagccgctgccccaccgcgcggctgaccgcgcgccgggtgagcaggtgctccgcgccgaacacctccggtgtctcggccagcaccgacgtcgcgccctgggccacgagcaggtccgaggcgtgcccgagcgccgggttggcggtgatcccggagtagccgtcggagccgccgcagttcaggcccaggatcagcttcgacgccggcacggtcgtgcgtcgccgctggtcgaggcggtcgagcatttcccggacgacgccggccccggcccgcacggtcgcccggatcccgccggtctcctgaatggtcagccgctcgatcagtgtgtcggccggcgcgtccagctcgctcagcagcgtctcgacgccgagcatctcgcagccgagaccgaggacgatcagcccgccgatgttcggatgggtcgcgtagccgcgcagcgtccgccgcaggatccggccgccctcactggccggcaccatcccgcacccggagtcgtgggacagcgccaccacgccgtccacgtgcggccacgcgtccatcaccggcccgcggaactggtcggcgatcatccgcgccgtcgacgccgaacagttcaccgaggtcacgatgccgacgaagttccgcgtcccgacggtaccgccggcccgctcgaacccctcgaaggtgcgcaccgaggacgcgccgggaagggccgccaccgccgtcgcgaactcgtagtcgtgctcgaccgcgtccatgcccaggttgtgcgcgtgtacgtgctccccggcccggatcgcttccgtcgcccgtccgatgacctggccgtacttgtgcacctgtgtcccggccgccagcccgcgcagggcgatcttgtggccgcggggaacggcggtgacggcgatcagtgcggcgccggcgtggtggaacgtctcgccggcggtcaggtcgcgggtggccaccgccacgtcgtcgcccgcccgcagcagcagcgccacctcgtgcagcgcgacagcctccgccatcgacgacctcccgactcggtactgaagattgctggaaacgtttgcatcgacatcctggcatgctcgtcgcggtcccgtcgagcgatccggggacacgtcccttgcgccgcgcgggcggcccgcgcttacctggtggtgccggatccgcgtgcggagggagcaccatgtcgggtgtgctgatcgggatcggtctcagcgcgttgagcaacgcgatcgcggacgccttcgcggccaccggcgcctatcagcacaaccggcgtgatccggaacgggtggcgctcagcgcggtcgccgcccgggcgctgtccgcggcgttcgccgacgcccgacgcgccgacctgaccgcctcccccgagtggatctccgcggtggccgccgagtggcgaccggcgttctcgcccgacgtcgtggcccggttgatgtcggtgatcgccacgccgtcggccgcgaaccagcaccgcttcaccgaggtcatccggaccgccctgaccgatgtcggcttcgacctggccctgctggagcagacgctgtcggtggagaggttcgccgaggcgcttccccggcatctgtggccggagctcaagcgggccgcgatcgccggcgccgcgctgcgcgacctcgtgcagcagttgctgagccagcgggccgagtatcgggagtcggcgcaggacgcgtccgagccacgcgagcaccggcacgacatgctgacctatctgcgggagacgctgcgggacgcgcggggagcggttcccgcgttcctgccggacgaccgctcggcaaacctgcaccagcgggtccgcgtgcggctcaagacccgggtcgccggccggaacgccgatccggacggcgaccgcgcctatcagccaccggtggagtacgccggcctcgacgagcacgctcccgcggccgaacggtcctgggacgaggtgcgcacctgcgccgaccggatcgtggtgctcgccgacccgggactcggcaagtcgtggctggtgcgcaccgagacgatccggctggccatggcggccctcgccgccctcgacgaggaccacgcggcggtcattccggtgccgatccgtgcggacgcgctggcggagggtctccggtggtcgatcggggaggcggccgcccggcacttcgccgcccggggacggctcgccgagcggtcccgggcgtacttcgccgagcaggtcgacgccggcaccgtgcacctgctgatcgacgggctggacgaactgcccgacgcggccacccggcagcggttgcgcgccgcgctcagcgactggtcccgccgtcccggcgtccggcggtggctggtgacgagccggatcgcgggctacaccggcctcgacacgcgcgacaccgaggagatcgaactgctggggctgaccaccggtcaggtcgagacgtacgtgcgcgcctggggcctgcccgaggcactccgcgaccggctgctcaaggccgtcgccgatccggcggtgtccggcatggcgcggatcccgctgctgctggccctgctgtgttcgctggccggcgcggaccaggacatcccgcgaaccagggtggaactctacggccggatcctgcggtggttcctgcagcgcccgcaccgcggcgccgaccggtccgaccgggagaaccagaccctgttggacctcgtgcaggaggtggccacccacttcgcgaatcgggacgcgggctgggccgacctgatgccgcacgatgcgctcaccagggtgatccggcagtcgccgagactcggcgatctcgcctgcacgccggaccggctgatcgagcagctgtcggtggagctggggctgatcgtgccggagggcgacacctcccggggccgccgcgcccgctacctgttcgcgcaccggaccttcgccgagtacctggtggcctgccacctggccaccctggacgagcaggaccgatgggcgatcatcgaacggcacctctggttcgacccggagtggctgcaggtgatctcgatgctcgggggcctgctggacgacggtgggacgcgccggctggtggagcggttgtgccgggtggacgacgacgtcctgcgacaggggtggctgatggcggtccgggtggtctccgaacacccggaggccgacggcgttctcaccgcggagagccggcggtcgttgcggcgcacgctggccgcggtggtgcgccatccctacctgcgatggtcggcggtgaccgcgctgcgcggcgttccggtgctcacgccggccgcggcggccgaactgctggcgctcaccgaggcggacgacccggatgtccggcacgccgccgtgcagagtgtcgcgagcgtcgaggatccgtcaccggtcgcgcatctgctcgcccgactcgacgacgaggacgagcatgtcgccgcggaggccgccaagtccctggccggacggcactcgccgggggtcctcgacgcgctgctcgcccgggccggcgccgaccggcgccgggtcgccctggcgtgcacggagtcgctgcgggcgctgccggaggcggtgcgcatcgccgccgtccggccgctgctggccgcgggccggccgacggccgtccgggccgccggctgtgccgttctccgtggcgccgggccggcggccgcggacctgatcctcgcgggtctcgcggacgaggacatcgacgtccgggccgccgcggcgcaggcggtgaccggcccgctggatccccgggtcgaagcggccctgctgcgccgcctggaggcctacctgaccgagtccgcggcgggcgccgacctgaccgtgtggaccggcgacaccggctaccgctcggacctggacgcgcaggccgcccgcgccgcgctcgaccgctgcgcctcacaggcccccggcttcaccgcggccttcctccggcaggtcgtcgaccgcggcgacagcgtcgaccggttcggtcgggacaccgggcccaccgcgcccacggccgacctggtcgacgagctggtgctgcgcctgagcgacggcggcgcgcgggccgggagggcggcacggctgctgcgggccatgcggccggacggcatcgacgacgcgctgctgcgcctgctcgacaccggaagtccggcggtcgtcgcggaggtgctgacggcggcgcgcggccgccgcgacgagcgcctgccgcaccgggccgccgagctgctcgcccacccggacgagaccgtccggcgcgcggcgctggagctggtcatcgacgcggatccgccgggcctggaggacctgctgctgcgtggcctgcgggacgagagcctccgcatccggcacctcgccgccggcggctgcgccggccgccacgacgatcgactggtgtccgcactcctggaacgcgtgcgggatcccgacgagggggcggacgtcgtcgggccggcgatcagcgcactgggcgatcgggaggagccgggcgtacgggaggccctgctcgcctgcctgcgtggggagaccgggggcgaaccccggcctcgtccgatgctgtaccccgggcgggcggtcgacgtgaccgcggccgccgtcctcgcggtggccgagccggagaccgtcctgagcgagatgacggcgcgcgccgggatcaccgacggctaccggggacgcgaggtcgccggggccctccggcggtgtccggcgcccggcaccgtggagttcctggtgcggatgcgccgcgaaggggcgcggaagacccggatcgcggcgcacaacgcgctgctcgcgcgcccctaccccgaggacctggtgacgctcgtcgacctgttggacggcatgccgccggagatgcggcaggacatggtcgtggtcgcggcggcgctcgccgcccggcactaccgcaagctcgccgacgccgaccggcgacgggtgcgcgggcggttgacggcggccgtcgcggcggccgcaggatagccgtcgctcccgtctatgatcagcgccgccggtgatcggaacgggggagaagcacgtgaggatgcccagggctctgctgacctacggcggtccggccgtggtggtcggcctggtcgcggcagctgtcggcagtgcgttgctggtgcgtgacgaccgggaccgccaccccgcggagtgcgggccggacccggccaccgtgcaggcgatcggcggcgagtcgatcctgcggcaccatccggaggccagccatctcaacgagctcagtccggacggctatcagtgcggggacagcccgatggccgcggtcagccgcagcctgatcggtccgctctcgcggtccgaggtggtccgctactacggacggctggcggaggcgtccggctggagacgtttcgacgggagccggcagatctactcggcgtccaagacgaccgccggcggctgcccgtggtggttcgtgatctccccgggccagaacgagtaccacctccaggtgttctatctgccggccgggatcccgcaggacaggtgcgtgtggaagtcgcaggagccgctgctgctcggcctcccgccgaagtaggcgccgcggaaccggccggggccggcggggcaccggtgcccgaccggttcctcggcgccaccggccgtatgggatcgggatgaccgcgcccggggcggcccggcccgtgggctgacatggcgcgacggccgccggctgaggccggcggccgatcgttgcagagcaccggtggagcgggccgcaccgtacgagcaacagccgatcgtgaccttctcagtgggccgccatcatcggggcgggagcgagtcgtgcccactcgacggtcgcgcggtgcgcgtaacggtagatgtccccctcggtcaccgagcggccgtacgcgtgctcgtgcgcgtgctgctcggcggtcgccaccagccggatcaggtcggccaccgagcctgggtgctcccggcagagccgcgccgcgaccgccacctgccggtccgagaccttgttgaggaactccggcatgccggcgcgccacgccgccgggtacaccaggtagccggccggcaggttgcccgggccgccgagcacgtcgaggatccggatcgggtcgaccttcggcgccggggcgttcatccccgcgtacatcaggccgctgccggccagcagcaccaccacgacgatcgccagcagcgggttgccggtgcccgtcgacatgatcaccccgaggatgatcaacacgatgacgccgccgaagaacgcggccatgctgccggtctcggcgttgcgacggtacgcctgctcgatgcacttgtggatcaggccgttcagcacctcatcctgaggccgccaggcatcggcacgagccggcacccggcggggcgcaacctgcgacatgttccctccctccgtggactgccgcgaacatcggctcacggccgtcccggttgaggaaactccgcctcacgccagcaggcactcgcgcatctgcttgccggggttccactgcccgacgatccggctcaccgtgggatcgagcacgttcacactccggttgctgcgcatctgcgtccgggccggctgcggcagcggcggcggatcggacatctccccacggatcgccgtcgcaccctggatcaggttgaccgccagggtggcgccgtcgacatcgaccagcacccggccgaactcccagccggccagcgtcagatcgaggacctcgaacatgtgggtcagcagcggcaggggatcgaccagtcggaccgtctgcgcggcctgcccgccgaccacgctcaccgcggcggcgacgtgcacataagggtgaaaaccggccaggccggtgaacaacggcgacctcaaccgcttcccggcggcctcccacaccggccggtagttgcgccgatccggcgtcagccccagcgccgcggcctgctgagccacgtcggcgaacgccgcgtcggcgaactcgcgcaacaccgtcgccgccaccaccagcccgtccggcccggccagcaacgcggccgcctgctccgactgggccgcgaaccggcgccccgcatgcgggccgaaccgctgccgcaactcccgcagcatcacctgctgctgggcgggatcctgcggaatccgtcgtttcccgatccctcggagccagcgcatgtcgcctcgtttccacccgcgtgccgaaccgccgcaatgctagagggcggcggcaccggcgtttctgtcacccttgttattgcgtacgccatcaacggcgcgtccggtcgccgccacgcggcgtgcacggtggaacagctgagggggatgcacgatgagtttcctggacaaggcgaaggacttcctcgacaagcacgacgagcaggtcgacaaactgctggacaaggccggggaacaggtggaccggcggaccggcggcaaatacagcgaccagatcgacaaggcggtcgacgaggcccagcgccgcaccggcgccggcgacacccagccctgagcaccccgggcccaccccgtggcccggggtgggcccgggccgccggcccgggtgcgcgacggcaggaacctcaacggcagggtcactgggctgctgcccggatcggtggtcaagggcgcgctgggcaaggcgctgcacagcacggtcaaggccgatcgaggcgcggtacgtcacggcgggctgcaaccgcgccgcgtcggcgggtgtggcggtgcgggtgtcagcgggtgtggcggtgcgcggtccgtgggtgttgcgccgtgcgcgtcggcgggtgtggcagtgcgcggtccgtgggtgttgcgccgtgcgcgccggtgggtgtggcgccgcgtcagtgggtgtcgcggcggcgggtcagggcgcggccccgggccttgcgggtcggggtggcacgggagtggtcgccatggcagcgatgcgggcgggcgaccgacgggccggccagcgcgttcaggccgaggccggccaacgcgtccgggggaggcccgggcggggcgatgaccagcgcgtagcggaaggcgatcgtgcggtcgacgccgacgacgacgccggtggcaccgaacggggccgggctcagaccggccgaccagcgtggcggatgctgcaggttggcggcgtcgtcgacggccaccagggtgaagtcgtcgccgtgggcggcatgccaggcggtcggcgccgcggcgggcgcggcgagggtgggcatggccagggagcggccgtcgaggagcaggcggcggccggagacgttggtgacggtgttctcgaagagcagcgtccaggcgccggcgccggacagcgaggcggtcagtgaacgccactcgtcgaaggccggccagcgcaggtggtgggcgaccgtcgcgctgtcgtcggaggacgacaggtcggtgatcgcgacgtgggtggcggcgcccggggcggcgtgcggcggcgtccaggtgaccgccgaggggagcgcggcgccgtcgagggtgcgcaggtcgcgcagctcgggctgggcggcgccgtaggagtaggtgaacagcggcacgtccccggcggagagggtgaccgatcggccggccgtgagggctgcgcgcagccggtcggcgagggggtgcatgcatctcctccaagcgagttcgagcgcacaaattccgacggaatcgctcatgaacaggcagagtcaacccggcccgcagaggtcccgtcaagccgaggcaggttaacgggtccataacgggggcggcgtcacccatggtgagcatgcgaattcgcacacatgtgaacacgcgccggtgtccacctccgaaccgcccggcagcgcggtcgctgtggccggaggcggtgtcggtggcccgggactgtgccgggggtcgctgtggccggagagggcgtcagcggctgtggaccgtggtgaggtcgccgaggccggagacggcgagcagcggggccagcagcgggccggtgacgacctcgatccggtcggcgtggcggaacagggcggccaggccggcactgtccagatattcgaccgcggtcaaatccaccagcagcggacggccggccgccggggccgaggcgctcagggccgcggcgaaggtgtccgcgttgctcatgtcgatctcaccggccgcggcgagcagcggcgcgccgtcgggttgctgcccggtggtcagcgtcagcgcggtggtcatcacacgatccttgtctgcatgtcgatgatggtcccggcggtgccggtggtgatggtgacctcgcccatgaaagcgcgcataagcatgatgccgcggccccggtggggattgtcgtccggctgggggacccgccagcgaccggtgtccgacacgatcaggcgcagcgcgtcggcggtgaccgcggcgcgcaaccggatcaggccgccggtcaggtcgcggtggccgtgctcgatcgcgttggcgcacgcttccccggcggcgaccagcacgttctgcgcagtgaccgggtcgatgccgcagcggtccagccaaccgcgcagagcgctgcggatcggggcgagccgggacgactcggccggaaactcgatctccagcgggccgggctggcggtacagcagcagggccacgtcgtcgtcgtagccgccggccggggcgaggcgttccatcacctcggtggccagctcctcgaccggagtacgccgaccggtccggaccgcgtcggcgacccgttcgatgccggcggtcagcggctgccggcggcgctcgaccaggccgtcggtgtagagcagcagggtggagcggggcgtcatcgcgtattcggcctcgcgccgctcgtcctgcgggcggatcccgatcggccgggcccggccgccgtcgagcagctcgacggtgccgtcggccagcgccacgatgggcggggggtggccggccgccgagtaggtcaggtgcccgttcgccgggtcgagcaccccgcagaacacggtggcgcagctggcgccgggcagcagggcggcgaaccggtccagagcctccagggcgcgggccgggcgggagtcctgcagcagcagggcacggcaggcggagcggagctggcccatcacggtggcggcgcgcaacccgtggccgacgcagtcaccgacgacgatgccgatccggccgtcgggcagcgggacggtgtcgtaccagtcgccgccgaccttgagcggccgggtggccggctcgtagcggaccgcgaagccggcgggcagttgcgccgggccgaggatggcgcgctgcagggcgagcgcggtctcccgttgctggtcgatctggtgcacccggcgcagaccctgaccgaggtgcccggcgagcagcgcgagcagggtctcgtcctgctcggtgaacgggcgtcgcgggccgagcccgatccagacgaccagggtgccgtccgggtgctccagggcgatcccggcgccttcggtgggggtggcgaccgcggtcagcggcggcccgtcgcgcagcgcgacgatccggtcctgcggggcgcccgcccaggtgaccgccgggtcggtggtggtcagcgcgggggtggcgtcgccggtgaagacggcgccgagcacgaccgacgcctgccacagcccgcgcagttcgtcgagggcgccggtgagcgcgtcggacaggtcgtcggcgccggagagccgcatgctcagcgcggccagcgcggtctcccgctggatcgcgtagtgctcgtcggtgacgtcccggaaggtgccgacgatgacccgccgcccgctttccgggtcgcgcacgtggttgaacgaggcggccacccacaaccggtggccgtcacggtgcttgaccgggaccgtgtattccccctggtgagcctgcatgagcaggtggaaggcgtcggcgacctcggcgtacgcctccggatcggactcccggtcgggccaccacgggtggaccggcgcgtacggcagatcctccggaccgaaaccgatcatgtcggtgaaggccgtgttgatctcgatgaccgcgccgtcctcgtcgcagacgaagaacgcctcctgcagcgagtcgaccagcgcggtgcgccagcgggcgtggtggttgcgcagccgggccagctccacgttggcgcggacccgggccagcagctcggccgccgagaacggtttgaacaggtagtcgtcggcgccggcctcgagaccctcgatcgaggcctcctcgccggcccgggcggagagcagcaggaccggcaccccggcggtacggttgtccgcccgcagcgccgtgaccagctccagtccggtcatccggggcatcatcacgtcgctgaccaccaggtcgggcgcgtcggtgcggatcgcgtcgagcgcctggcggccgtcgccgaccgcggtgacccggtgcccggccgagcgcagcagccgggtcaggtagtcgcgcatgtcggcgttgtcgtcggcgaccaggacgtcggcggtggccccgtcgagccgggtgatcggcgtctcctcgggtggcgggtcaccgggcagccagcggttcgcctcctgcaggaagggctcgaccgtggtggacggcgcggccgccgagccggacgcgaccacggcgtcggccggcaggtgcgcggcgccgaacggcagccggatggtgaaggtggtgcccccgcccggttcgctgtccgcggtgacggtgccccggtgcagtccgaccagctccttgaccagggccaggccgataccgctgccctcgttggaccgggaccgcgcggtgccgatccggtggaagcgttcgaacagccggggcatctcctcgggtgccaccccgatgccggtgtcggccacggtgatcacggccgcgtcgtcgccggcggcgaccgtcacccggatggcgccctcgaaggtgaacttgagggcgttgctcagcaggttgaggatcaccttctcccacatgccgcggtcgagaaggaccggctcgggcaggggcgggcagtccacctcgaaacgcagcccggcgcgttcgatcgcggaccggaagacgctggccagttcgccggtggtggcggcgaggtcgaccggctcgaaacgggcctgcatccggccggcttccagccgggagaagtcgagcagcgcggtgaccagtttgccgagccgcagcccgttgcggtggatcacgtcgagttcgtcgcggatcggctgatcggcgccggccagccgggtgcgcagctcgtcgaccgggcccatgatcagggtgagcggggtgcggaactcgtggctgatgttggagaagaacgtggtcttcgcccggtccagctcggccagttcctcggcgcgccgctgctgggcctggtagctgcgggcgctgccgatcccggccgccacgtgcccggcggccagctcgacgaagccgcggtagggctcgtcgatcggccggtagcggttcagcgcggtgaccatgaacccgaacggctgcagcggcaccaccagggcctgctcgggtggggcggtccaatcgccggtgggcaggccggccccggtcagcgggaccagccgcgactcggtggcaccggcgtacgggtggtccgcctcgacggtttccggcgcggccgggtggcccggctcgatcccggtggccgcgcgcaggtgggcgcggccggcctcgtcgtacaggtaggtgagggtgaacggcaggtcgcggcggttgcggtcgagctggcgggcggcgaaggccagggtctcctgctcggtgcggatcacactcgggtcggagccgaggtcgcgcagcgtcgccatccgccgctcggcgatcacccggtcggtctcctcgctgaccacgcagagcatgccgaccagcgcgccggcgtcgtcgcgcagcgggctgtaggagaacgtgtggtaactctcctccgggtagccggagcgttccaggaacagcagcaggtcctcgtcccaggtggcctgaccggtgtcgagcacgttctggatgcgcgggccgatgtcgggccagatctcggcccagacctcccgcgcggaccggcccagcgcccacggatacttgcgggccagggtgtcgcggcggtaggccgcgttgcagaagaaggtcagctcgggaccccaggccatccacatcgagaagcgcgacgacagcaggatgctgaccgcggtgcgcaggctctgtggccaggcatccggcggcccgagcggggtggccgcccagtcgactgcggcaagatcccggccgacctcggcgtccgctgcgaagacgtcgctcaccgtacgaagttcccctcacccgcacagaacggttctcaaagtacgcgtccgctctacccacatggcgcgcggtctaccccggtgggccgtggtgccgcgcgccaccgggcgcggtgcgacgatcaccgcacgctcgatgaccggcgacggtcgagcagtcggcgagcagccgcgtgacgtaccaaatcatgttttaaaggggtgtgcctttctcgtggggtaggccgatcggccggtcgtccgcaccgatcgtgccaccgcggtatctgcccgccggaaaacggctccttcctgtgtgtccgaccgcagaacaggagctacggaatgagcgagctgatcgacgcccggctggtctccgggaccgacccgaacggcggctccggcgaggccaccaaggggacccagcaggacatctatttcttcacctcgatcgaggatttcccgcccggcgtcggtgatctgagcctgacgcacgacgatgcgcagggattctacgactacgtgaaacagttcaacacgcccaacggctggtacagggacgccagcgtggggcagtggatctacgaggagacctacgacaactacctggacgactacggcttcgacgcggccaaggtggtctatcactccgggcacggcggaatggcgagcaacggggtgttctccattccggtcggcaacgactggggcggcgaccactggaccagttccaatgacatgcggctgggcaacgaatacgcccgttacgtgttctggtcgacctgcgaatcggtgcgggtcaagggcgggcagtcgccgatacggacctggcagaccgccaacctcgggctgcggatgattttcggatacgagacggtcagcgtcgacaacggcgactacggccgtttcttcttccaggagtggaacaagaacaagtcgttcagcaccgcgttcctcgacgcgtcctggcggatcagccacggccaggagccggcggtgaccgcgtgcggcgcgacccaggccgaggccaccgatcggctgttcaacgaacggctcttcgacgccggccgggccagcaccacctggtggtggtggcgctggtacgaccgggccagcctgcgtgcccgcagcctggacgtgccggccggggtccgctcggcgaagttcgccgcggccagcgcgcgtgacctggccggcgcctggaccgaccggttcggcggcgaggcccggctggtgctcggcgcgaacggcgcccgcgaggtcaccctggccggcaccgccgtcagcgacgcgcggctcaccgacgagcaggcggtcgcggccgcccggcaggcgatcgagcggtaccggctggccgagcatgccgacctggcgctcgaccacatccgttacgaccggcacgccggggccagcgccgacgagcaggtcgacgaacaggtgcgcgagcggagcgtgggcttcgtgcagctgatcgacggggtgccggtggtcagcccggacggcgggcggctgcacgtgcgggtcgacaacgagggcacggtcaccgggatcgccgactccacccggccggtcgccgacctgcgggacgcctccgcggcgccgccgcggccggtgccccggcagcggaccggcgtcgacgcggtgtcgaacctcgacgaactcttcggcgagtcgctgcagcggcgcctgcgccgggccgcggccggcgggcgggtgcccagcgcggtgcgggtggtgccggactcgaccgaggtcggctacgcggtgcacggcgacggcgcggtgctggtggcgcggcgcgaggtcgaggtcgacttcggcggcgggctggccaagcggtacgtgctggaggagcccgtcagctgatctccgggccgctgtggggcggggccgggcaccgatgagttgcccggccctttcatcgatgcttgacacgttccgttcacaaggaaacactgaggaaacatttgtgagagcgctctctcgtcttcccccgtaaggacggcccatgagactcgtcccccgcctgctgtacgcaaccctggccaccgtcgtgctcgccgtcatcggcacccccggcaccgcctccgcggccatcaccggcaccaccatcgccgcacccggcggcacctgcgtcgacgtcagcggtgacgacaccggcgtcaacggcaccgccgtccagctctgggcctgccagagcaccagcgccgaccagcactggacgtggagcggcaccgcgctcaccacgatcggccgctgcctcgacatcaccggcggcggcaccgccaacggcaccgcactccagctgtgggactgcaacggcaccggcgcgcagcagtggaccccgcaggccgacggcagcctgaagaacccgcagtccggccgctgcatggacgcgcccggcggggccaccgccaacggcacccggctgcagatctgggactgcaacggcaccggcgcgcagaagttcaccgtcggcacccccaatccgggcacctgcccgacctactccgacaccccggacctcggcgccaacgtgcacatctacgaccactcgatgaccgacgccgccatccaggcgtcgctggacagcgtgttcaacgcgcagaaggacaccaacaccgcgcagttcggcacccggcgcgacgcgctggtcttcaagccgagcaccacgccgtacaacgtcggtgcgaacatcggcttcaacacctcgatcctcggcctcgggcagaacccggacgacgtgcggatcaacggcgcggtgacggtcgacgcgttcaacgccggcgacgccggcaacgccacccagaacttctggcgctcggccgagaacctgtcggtcaacaccaacggcggcaccaaccggtgggccgtcgcgcaggccgcgccgtaccgccggatgcacgtgatcggcggactcaacctgttcccggccagctacggctgggccagcggcggctacatctccgacaccaaggtcgacggcaccgtcgaatccgcctcccagcagcagtggtacaccaaggacagcacgctcggctcgtggagcggctcgaactggaacatggtgttctccggtaccaacggggcgcccgcgacccacttcaccaccgacccggcgtccggcccgcgctacaccaccctggccaccacgccggtctcccgcgacgtgccctacctgtatctcgacgcggccgggagataccgggtcttcctgccctcgctgcgcaccaacgccagcgggcccagctgggccggcggcagcaccccgggcagctcactgccgatgagcaacttctacgtcgccaagcccaccgactcggctgcgacgatcaacgcggcgctcgccaacggctgcaacctgttcttcacgcccggcgtctaccacgtcaaccagacgctgcacgtgaccagggccggcaccgtggtgctgggcatcggctacccgacgatcatcccggacaacggcgtcaccgcgatggacgtcgccgacgtcgacggggtccgcctcaagggtctgctcttcgacgccggcaccaccaccagcgacaccctgctcaaggtcggcccggccaagtcgggggtcgcgcacgccggcaaccccaccacggtccaggacgtgttcttccggatcggcgggatggccgccggcaaggccaccaacagcctggtcgtcaacaccaacgacaccatcgtcgaccacacctgggcctggcgcgccgaccacggccagggcatcggctggacggtcaacaccgccgacagcggcctcctcgtcaacggtgacaacgtcctggccaccggcctgttcgtcgagcattaccagaagaacgaggtggtctggaacggcgccaacggcaagatcgtcttcttccagaacgagatgccgtacgacccgccgaaccaggccgcgtggatgaacggcagccagaacggctacccggcgatcaaggtggcgaacggcgtcaccacgttcgaggcgtggggcctgggcagctactgcttcttcaacgtcaacaacgcggtggcgtccgcacactccttcgaggtgcccgcggtcgccggcgtgcggttccacgacatggcggcggtctcgctcggcggggtcggcaccatctcgcacatcatcaacaacaccggggcggccgcgaactccgccaacaacaactcgtacctggtcagcttcccgtaacgacgggcgggcctccctcaagcggccgggaacaggtctgtcagcagggcttcgacgcgggtcttgatctcgtcgcggatcgggcggacagcggtgacgcccttgccggccgggtcgtcgagcttccagtcctcgtagcgcttgccggggaagaccgggcaggcgtcgccgcagcccatggtcacgatgacgtcggactcccgggcggcgtcccaggtcagcttggtcggggtctggtcggtgatgtcgataccgacctcgttcatcgcttcgacggcggccgggttgatcgtcccggcgggggcggagccggcggagcggacctcgacgcggtcgccggcgaggtggcgtagccagccggcggccatctgggagcggccggcgttgtggacgcagacgaacaggacggtgggcttggtgtcgctcatgatgtcctcgcggtggtggaggggaggggtggaagccggctcagggcgcggtggcggggtggtcgacgacgatgtcgtccgccgccctgccggcgtcggggtacagggcgagcagcaggccgacgccgacgagcaggccgacgagttggaaggtgacgaacccgggcacggaggccggggcgatgccggcgaacgtgtcggtgaaggcgcggccgatggtgacggccgggttggcgaagctcgtcgacgaggtgaaccagtaggcggcgccgatgtacgcgccgaccgcggcgggggccacggcggctctgccggaccggccgagcgcgaagatcaacagtagcaggccggtggtggcgacgacctcgccgagccacaggtgcccggcggcgcggcttctggcggagaaggtgaccggggcgaggtcgaacatcaggttcgccaggatggagccgccgatcgcaccgaggatctgagcgatggtgtagccggccagatcggcgccactgatcccggtgcgggtgcgccgtcccagccaccagtcggccgcggatacgaccgggttgaagtgggcgccggagatcgggccgaaggtgaggatcagcgcggcgagcgcgaacgcggtggcgaccgagttctcgagaagctgcaggccgacgtcgcctggcgagagccgggacgccatgatgccggagccgacgatggcggtgaccagcagcgcggtgccgaggaactcggccagcagccgccgccagggtgcgagagaaggcatgacagtgcagctccgggtgtggtgggtggtcagccctgcatcgatcctgcgggttccgggtcgtgggtgtgcgggaggcatcggccggcacgcggcgcagggtggtcggtggcgcgacgtcgtcttcatcgagcgccgcagcgcccgcctgtgacgggtggtcgggatcaggccggcacggattcgtcgaccgagagcagggtcgacagctgtcgcatcagctccgggcgggggcggtagtagacccagctggcgcggcgttcgccgtcgatcagcccggcttcgcgcagcaccttcaggtggtgcgagatggtggtcccggagatcgtgaaggccggggtgaggtcgcagacgcagatctccccgcccggcgccgaggcgatcatcgacatcagctgcagccggatcgggtcgcccagcgccttgaatgcctgcgcgagggtggcggcggcgggggcggggatccgctgttgcgccatcggcgtgcagcagggcgtctgtggggcgacggacacgaccggtggtttcgacatgggtcgaggttgacagatatcgaagccgcgtgcaaccttggcttcgacagtcatcggattcgacacgtttcgaatccgtgtgatgagctcgacgaaaccgccatccgactcggccttcattcaccaggagtacccgcgatgagtagcgacacttccgacaccgccccgactgccaccgggcaggacccatgctgtggcaccgtcgaacaggccgcagccgccgacgcctgctgcgccccggacgccaaggcggaggcggtcgccgacggcgccggctgctgcggtccggccgcacaggccgcacctgtgcaggccgaccccgcggccggttgctgcgggccggccgccacggtcagcgcggtggacctggccctcatcccggcagcgccaccggccggcgtaaccgcgcggaagccgggggatctgccggtcgtggtgatcggcgccggaccggtcggtctggccgccgccgcccacctgcacgagcagggcctcccgttcctggtgctggaagccggtgaccaggtcggcgcctcgatacagcagtggggccacgtcggggtgttcagcccctggcgttacgacatcgacccggccgcgcgccggctgctggacgccgccggctgggccgcgccggacgacgacggcctgcccaccggagccgaactggtcgagacctacctgcagcccctcgccaagctgccggcgatcgccccacacctgcacctcggcgcccgggtcaccgcgatcagccgcctcggcgtcgaccgcgtacgcaccgccggccgcgccgacctgcccttcgtcgtgcggctcgccgacggcaccgagatcaccgccagcgcgatcatcgacgcgtccggcacctggcgcacccccaaccccctaggagtgaacgggctgcccgcccacggcgagcccgacgccgccgacctgatcgagcacgccctgcccgacgtgctcggcaccgaccggcggcagcatgccggcaagcacaccatcgtggtcgggtccgggcactcggccgccgataccctgctcgacctggcgcggctggccgagaccgagcccggcacccggatcacctgggccgtgcgcggcggctccgcgcagcgggctttcggcggcgagggcgccgatgagctgccggcccgcggcgcgctcggctccggcctgcatgccctggtcgacaccggcagactcaccctggtcaccgggttcggcgtgcagaccgtgcgccgtgatgccgccggcatcaccctggtcgccgccgacgggcgcaccctgagcgccgaccgggtcgtgtccgcgacgggcttccgcccggaccacagcttcgcgagcgagctgcgtctggacctggacccgatcctgggctgcacccgcaccctggccgacctgatcgacccgaaccggcactcctgcggcaccgtcgccccgcacggctaccgcgagctcggccagcccgagccggactactacgccgtcggcatgaagtcctacggccgggcgccgaccttcctgatggccaccggctacgagcaggtccgctccatcgccgccgccctcgcgggcgacttcgccgccgccgacgacgtgcagctcgacctgcccgagaccggggtgtgcagctccagccgggtcgccgggaacgccgcccgcttcggctcgtgaagcaccccgccggctcatcggtgcccgccgaccggcgcgccggcgggcaccgacggtcgtcaccgcccggtaaccggaccctggtcccggcattggcgatcacccagaccatcggctacggcaccctctactacgccttcgtcgtgttcctcgtcccgatcgctgccgacctgcacacctccaccaccgccgtgaccggcgcgttcaccgcctccgtgctcacctccgcggtgctggccgtgccgctcggccgccggctggaccgccacggcggccgcacgctgatgacctgcggttccctgctcgggaccatgctgctggtggggtggtcgcacgtcggccaggtgtggcagctgtacgccgtgcagatcggcatcggcgtcgcgtcggcggccagcctctacgaagccgccttcgccgtgatcatcgcctggtgccggccggagcgccgctcgcgggcgctgcttacgctgaccgcggtcgccggattcgccagcaccatcttcctgcccctgaccggttggctcaccgaccagcacggctggcgcaccaccctgctgatcctcgccggcatccacgccatcaccgcgccactgcacgccgccaccgtccgacggccaccagcagccacgaacctggtcacccggcaccgcgacgtcgatgcctcagtcgttcgggccgcgctggccgatcgcgcattctgggtgctgacggccggattcaccacgcatgccatggcgatcagtgcctacaccgtactgctggtcgccgccctcaccacgtggggccacccacccgccttcgccgccaccatcgccggactcctcggcgtcctgtccgtcaccggacggctgatcaccaccagcctgcaaagccgctaccggaccaccaccatcaccgccggcatcttcgcgatccaggccgccgcggccctgctactgcccgcagtcggcgccagcaccggtggcgccatcgtggcggtggtcgggttcggcctcggcttcggcgtggccaccatcgccaaacccgtcatcctcgccgagcgctacgacacccgtcgctacgccactctcgccggcgtcctggtcgcgccgatgaccctcgccaaagccggcgcaccgctgggcgcggccaccctgcaccgcaccacaggcgggtacacgtccgtgttcacggccatcgccgtctgctgtgccgtggcggctgccgcaatcggagtctgcttcccgggtccccgcgatcatgacatcggcggggacggcgtccacgacgaatagcgcccaccgcccggccgggcgtcacccgatgctgatcctcgcccgggtcagcgtgatgtaccagtcggagccggtgaaacccgcgccggtctccgggccgatgtaggcgtcgatgtgcttcgacccgcccagccccggcgtgaactcgtcggtgacctcccaggcgccgtcccggagcgcggcgcagaccgcctcctgcggggcggaaccgtcatcctgcgagccgcagtcctcgatcgtgaagcgggtgccgtgcggcagcacgttcggatcggcggccgccgacacgaacggtcgcagccggtccccgtcggtgtcgcgcggttcgctgtccagccaatagccgacgtcgtacgaccagttcaggtagtgaccgtcggcggtctggccggtgccctcgtccttgaccgcctgcacgaagtcggccgggtaggaacccaggtcgtccttgccgttcgagcagtccagccggtcgcagccggttacccgggtgggcgcgccggtgtggaaacgctgcaccgcggtgtagtagacggtgatctcccacccggtgctcacccccggcgacaccggtaccgacgtgctcacccgggggctggccgccggtgtcagcccggccggcttcaccgcgccgggcgcggtgccgcacccgcccaccacgaccaggatcgaggcggtggtcagcaggcgggcgcgcatcttccgagcattccaaccaacgccgtgtcgcggcggggaaatcgggctatgcggcgagcgccgaccccgcgtcgcggcggggacatcgggctatgcggcgagcgccggtcccgcgtcgcggcggggacatcgggctatgtggcgagcggcccggacccggtgagcatgtcccggaccatcgggatcaccttggcgccgaacagctcgacggcgcgcagccgggcgccgaccggctgggcgccgaccgtgtagaccaggtcgaagcggcccacgtccagcgcccggatcgcgcggctgatcttccgggcgacggtgtccgggctaccgacgtacagggaaccgtcctcgatctccgcctcgaattccgcgcggcgcagcggcggccagccgcgggacgcgccgatccggtcgcgctgcaccctgtagtgcgggtagaacagctcgcgggcctgctcgtcggtgtcggccaagaagcccggcgagtgcatgccgacggggtgtgcgaccgtgccgagctgcgcggtggcccgccgatagaggtcgacgaacggcgcgaaccggtccggcggcccgccgatgatcgcgagcatcagcggcagtccgtgccgggcggtgcggaccaccgactgcggggagccgccgaccccgacccaggtgtccaggcggcccgactcggtccgcgggaacacgtccgcgtcgacgagcggcgcgcgggtcgtcccgctccaggtcaccggcttctcgtcgagcaactggacgaacagctcgagtttctcctcgaagagcacgtcgtagtcgctcaggtcgtacccgaagagcgggaaggactcggtgaacgagccgcggcccaggatcgcctgggcccgtccgccggagaccgcgtcgagcgtggcgaagcgctggaagacccggaccgggtcgtcggagctgagcacggtgaccccggaagccagccggatccgttcggtgcggccggcgatcgcggcgagcacggtctccgggctggtgatcgaatactccgggcggtggtgctcgccgagcgcgatcacgtcgacgccgagctggtcggcgagcaccgcctcgtcgacgacccggcggagggcggcggcctgcgagagcggtgcgcccgcgtcgtcctgcggcacgtcaccgaaggtgtccaagccgaagatcacgtctgtcattgccacgtcaactatcccgtcgacacgtttatgcccgtcggtccgcgcccggcgaaccggtagtacgagtccaccgccggctgcccggtgtagttggccccggcccggtcgtcggcacccagatactcgccgggaatctcccacttgcgcggcccggtgcagctgatccgtcggcggcggccgtcgtagtcgaagccggcctgccgcagccgcccgacgagccggcgcccggccggccgcccgtccgccagccgcacgccgcccagatcgagatcggcgacgaaccgcccacccggcgccagccagcgggccacccggaccagcatgcccagcttgtcgcccacgtaatgcagcccgtgcacacaggtgatcaggtcgaacgcccggtccggcgcccagtcctccagcggcgccgccacgaacgtcaccccgtcggcggccccggcgaaggcgtccaccagatccacgccgatcagcgtcgccgcgccccggagccggccggcggcctgcagcagcgcccggccgctgccgcagcacaggtccagccaggcggggtccggcccggtcaggtggcccaccggatcgaagccgagcacccgggcgtagctgttgacgccggtgagccgacggtcccggttcatcgcgttgttcgcccccaccgaggaggcgtgcagcgcccgctgatcgagcagtcgcgccctcgcggtgtcaccggccgggaactcgctcatgtaccgatcatgacgcagggatcggcggggccggcatcggcgtaccgccgccatcgggtggtgatccggtcagacggcggcgaagcgggcggcgaaggcgaccgccttcatgtcgccctgccgcagccgggcggcgatctccgtctcgccgatcgtctccagggtgcgggccgcggtggtgatcgccgccggttcgccgcgcagcaggctgcgggcgaagcgggcctgggtggagcgcagcgtggcgaacgcgcacatgtccagggcggcgacgaagtcgtcgttcagcgtgccggccagcgcgtgctcgaccaccaggtcccgcagccactccggccagtagccgtagcggccgagcagccggccggcgtggatcgcctcggtcggggtgcggccggcgttcagcagattcgcggtgacgttgacgtccagctgcgcgacccgcaacgcggacacgaagatgcgcagcaggacgaccgcgccgacccggggttcgatctcggcggccgcgcgcgcgtagtcgccgccgatcacccaggacaccgcctcggcctcgagcagggtggcccggtcgacgtcccggtccgcgagccgctcgatggtctcgcggagccgggccgccgccttgtcgtagcggtcgcgaaggccctcgctgcccggtctgttgcggtacgcgatggcgatgtcggaggcgatgtccgcctcccgctgcagcagctgcgacacgatcttgggcagcaacagctcggtcaggccggtggtcaggatggcctcgtcgaaccgctcggtagcggtctggaactgctgccaccactcgaccggatgcgtcgcggactgctcgatgggcatgaccgctccatcggccgccacccgggcgtcccaagcgtttcccggggctcaatccgcggtgatcgcctgtccgtagacgtgcgtcaccctcagcgcgagcagcacccgccggtcgtcgaccattacccgccggtactgcgcccagtccgggtgctcgccggccgcccggcggaagtagtcgaccagcgcctccacctccgggccgtgcgggtcggtgcccgggccgatcagcgtggcgaccccgtcggcggtcgcccaggaccggccgtcggcgctggtcaccgagatcgacccgcgcgggtcgcggcgcaggttggcggtcttggcccggccctcggtcatcgacacgaagatcgttccggcgtcccggtcgtagaagggcaggatcggcgacagctgcgggcggccgtccctgcgcagggtggcgagaatcccgaggcggcttcccgcgatcagcgcgtgcggatcgaaatcggtggtcatgtctgtcgccaagtcgcggcgccgggccggtattccggcatgggacaacgtgatgcgtcgatgtccggtatggtccgggacctgtgttccggtctcgggcagaaggggactgtgtggcgcgatggacatcgacaaccgcaaatcctggcgcacgctgctggtagcgggcgtcgtcggcctggtggccgccgcgatcggggtgggcgtcggggtcggcgtcgagccgcaccggccgaccgcggacgacctgtcccgcatcccgggcctgccgtcgttcccggcgctgcccagcggattccccaccgacttcccgaatctgcccgacctcccgaatctgcccgacctcccgaacctcccaggtggatcatgaggatgctcccgttgcgcttcctgcaggcggtggccgttctcaacggcatctacgccgtgcacgtgctgatcgacgcgctctccccgcacgccgacggcgacccggccatcggcatcctcggcgacctgtggcccaccctgctcaaagccaccttctgggcggccgtcaccggctgggtcgtcgcgggtggcatcctcgtctgggcgcgctcacgcggcccggtcggcccccgcgagcagtggatcgccgccggcgcgctgatcctgccgttcgccgtttacacgctcggcatcgtcgcgccgcacccgggtacgctgctgctctgcctgccgagcaccgcgttcgggctgtggaccgcggtccgcttccagcgctggcggcggctgccgctgcgcctcgtgctcgcctgcttcgcctggggtgcggtgatcgcctccgggttcgccgcggcgtgcaacaccctggtgatggagtacctggtcgactacgtcggcggcctcgacatgatcaagacgatgcacgacgtctatttcgggctgttcctcaacgccggcttcggcgaggagttcggcaagggatgcgcgctgttcctggcgtatgtgctgttccgcagccgcttcgacgggccggtcaccggggtggtgctcggtgccgcggtcgggctcggcttcaacctgtccgagaccgtggagtacatgacccaccagggcggcgccggataccagtacttcgtccggcagtcggtcgggctgatggccgcgcacaccgcgttctccgcgctgctcggcgccggcttcggggtggccgcgctgctccccgaacgccgtgaccgcgcgctcgccatcgccggcggctacctcggcgccgccggctcccacttcatgaacaacgtggtcttcagcgcgctgtcccgcggcgacatcaccctgccgttcacacccggcccgacggtggccctgctcctgctcaccccgctgtacctggccgtactgcaggggccggccgtcgtgctctatctgaccctgatgcggcagggggtgcgcgggcagggcaaccggctgcgcggccggatcagggacgaggcgcggcagccgtacggcgtgatcagcgaccgggagctgaccctgctgctcgacccgcgcaaacggggctggctgcggctgaccaccctccggcggtacgggtgggcggcgtaccgggcgctcgggcagttgcaggccgcgcagtacgaggtggccgccctgcgcgacgagcatcccggcgaagcgaaggagcaccgggcccgggcccgccgattccggtccgacctgcgtgccgccaccgcggtgcggcgcgccgagcccgcgggagcgccggcatgacgacacggttgcggcgacgcctgatgtggtgtgccgggacgctcggcgtgtccggcttcctgctgctgatcgcgccgacaccggcgtacgcggcctgcgcgccctcgtatcaggaggtgccgggacagccgccggccggcgatgcgagctgcggtggcgacgcggccgcggcggccggcgtggtgctcctgctggccggggcggtcggctcggtcgccgtgccgctcgcccgggccgcgggtctgcaggccgggggtgatccgccgatgagcggcccggagaccgcttccgagctggcccatgtgctcgaaggcacggccgagccgccgccgaccgtgcagctcaataggagcggtgacccgtacgacagcaggaccggccggttcgtcacgaaagagaccgacggccggctgcgcaaggcggctccggtccgggtgacggcgtatccgcgccccgccgatttcccgatgatggaccgggcggtcgaccggtacgccgtggccgacggcgcccggacggcgacctacacccggccgctgccggccgccaacggggagacgctggaggggctcggcccgaaactcgaggcgatcctccgagccgccgagccggatttcaaggtcgacaagacggcctacagcagcggccggcggtacgagatgctgaagcaggcggcacgacagctgttcaacaacggcgactaccgcacccccaaccgggccttcgccgcattcctggaggccgccgacctgttccgcgaacagctgcagcccctttccgaggccggcaccgcgctcggcgtcgccggcgaggagtgggtggtggcacaggtgctgaaggttccgccgatcaccgtctccggcaccgggaccgcgaagtcacgggagttcgacagcgtcatcgtgagtgactggcccgaggagtggggtgccacctcggcggggccggtcctcatcctgtgtgagtccaagggacccacccccggtctcggggcggcgaaggtccgactgcccgacggtacgtggacgcgtgcccagcagggcgaggtgcactatctgggtcgcacgctggcagtcgacgccaagctcgcgaccgccctggacgccgtcccgggccgccgggagctgatccagcggctggtcgacgcccgcgccatccggtacatcaaggtgcgcacgctggaaaccggccggatcgtcgtccacgagttcactctcgatccggatgttctgcgatccttggtgctcaagcttcccgagacagcggagtccccgtcatgagtttcacccggaccgacgatgcggccgtacgcgacctgctgaccgccctgcgtgacgtcccctggcactggcggctcgacgagctcgacgacctggccgcccgactcggctggcagatcaccgaccgctgggacaagggcgccgagttcaccgtcggctggccgctgcccagccggggcgcgctgctcaccttctggaagggcggcggccggcagatggacttcgacctgaccgcccgcaccgacgacaccccggagaccgacgccgccgccgacgacgccttcgccgacttcgccgcgatcgccaccgacgtcctgggccgtcccgaccggaccactcccggcatccaccccagcgtggcgtggcgcaccgcggactccaccttcgagctcgccgtcttcctcggcaccgtcacgctgacctggtcgtcgaacgcctaccagcagttcctccgggacaccacggtggccgacccggccgacgacggggacggggacggggacgacgagtgaccgccgacccgtggaccgccctggccgaccgcctggcccggctcctcacccgccgggaagccgacgacttcctgatcctgcacgccggcccgtactacgtgcagtgctatcaggggccggccgagttgtacgccgaggccctcgccaaccgctccgacttcccgccggtccgcctccctgcggccgccgagcaacggctgcgtgacctcggctggcagcccccggacggccccgacgagaactggacgacccgcctgccgttcccggcctcgcaccgccaggcccgcgccctcgccgaccggatgctcaccaccctgcgggaggtctatcaggtcggcaccatcaccgacctgcggtacgaggccaccaatgcccgcgccgggacaccgtggaacgccgcgcccctcggcctgctccccgccgggtgatcaccgcggcgccccgcaccggaactctgaccggcatccggcgccgggtgccggaccaccgtgccccggacgtgccttctccgcggcattcgccagcaggcctgcggatcgccgatctagcgtgggactgtcagtcggcctgcgttggaggatccgtggagtcgcttctgaggacagggtcgcgcttccttctcggcctgctggaggccgcgacagcgtacatcctggtatgggctgcgctggcagcgctgcaccgagacgagatagggctgccggaattcggcgcccgcctggaaatccccctggtggcgctcctcagtgccgccatcgccgtgttcgtcgggcggcggcatgaggaccgcgggcatcgcaaacaggctgcgggtgtgttctggggggccgcgctgtttcctctcgtcgtcatcctggtggtcgttctacgctggtggacggcgtggtcccgaggcgggatctgaacggcggacaggcgcggccggggcaccggcaccgcccggtgaggggtcacgtggcccgcaggaagtcgcggatcccggccagccacaccccggggttgtcgaagtgtgccatgtgcgcggcctccggcacctcgacgagggtgctggccggcagcgcggcgtgcaaccggcgggcgacgccgaccgggaagcccatctcccgggcgccgtgcaggatcagcaccgggccgccccagtcgcgcaggaccgcctcggcgtcgtcggggccgccgggcagcagcgcgcccgaggtgtacagccggttgtagtcgctggtgaaccggaccgccgcgagcacccggtgccagtcgtcgagccggtcgagccgccacacctgcagcggggcgtcgccgtaggccatcgcgcggctcagcgcgccgtccggtccggtgaccagcgggtcgtcgaagcccaccgcggtgcacagccggcgccgcgcccggtagtcggcggacgccgccaactcgtcgtcgaagtcggtgtacgccgtggtcgaggccagcacgagccggcggacgacgccgggatgctgctcgaccacgcgcatcgcgatccggccgccccaggagaagccgagcacgtcggcgggaccgctgccgagcgcctcgatgagcgcggcgacgtcgtcggcgagccggggcggctgcagtgcgccgtcgggcaggtcgccgatcggggcggtgcgctggctgcgtccgcagccgcgcaggtcgaacaggacgacgtgagccgtgtcggccaggtcggcggcggccggcaaaagatagctgtggtcccaggtggggccgccgtggatgaccaccagcggcggcaggtcgcggtcgccgaaccgacggacgaacaggtcgacgccgttgaggcggacgacggaaccccggtcggtgacatcagccagattcaccaccgtgatctttccacatcggccgccggataatgaccgcatgatcgtgctgatcgacgacctgcggtcgttcgtggacggccgggccgccgaggtggcccgcagcagcgcggccggggtggcactgctcgaccggctccgggaacatcgcctggacgagctgtggctcgaccacgacctgggcggggaggacaccatctggccggtggtggcggtgctggagcgggccgccttcgaggagcggccgttcgacgtcggcctgatcctgatccactcggcgaatccgtccggggcggcgaagatgggccaggcgctgcgccgctggggctatccggtgcggctggcggccggctccgccgcggtcggctaccggggccacacgtgacggaggccctcacccgggggtggggccttcgtcagaactcgaccgggaacgcggatctctgcctgacgaacccgggcggctactgcactcgacagtgccccgacgaccccgggggttaaacccggggagcacaatcgcgggatgtatgtgatcagggaacgcttcttcgccatcggcgacgacttcgacgtgctggacgagaacggcgcgaaggtctaccgggtggacggcaaggtgctcagcctgcgcaacaaggtggtcatcgaggatccggccggggacgaggtggccacggtgcatcggcacctggtgtcgctgcgaccgacgtacgagatccggatcggcggcgagaaggccgccgaggtccgcaagaagctcttcaccccgttccgggacagattcaccatcgacgtgcccgggccggacgacctggagatgaagggtgacctgctcgatcacgagtatgtgatcgagcagggcggcgaggaggtggccgcggtctccaagcgctggctcaccatccgggacacctatgcggtccgggtggccgcgggcatcgatccgctgcttatcatcggcagtgcgctggcgctcgatctcgcgctggagcgcggtgtgcaggacgacgaggactgagctcaaggatggcggtcgcccggtcgatgagccagggcatggaggccagcgcaacgcccgccggcgccgcggcgcgcggcgcggcgctggaccgcgccctgaccacgctcgaggaacaaccgcggtacgggatgaacctcgacgagtggatctcccgggcgatcgacctggaggccgccgccgaccggctgggccgcgctgacctggcgttgcgcgcgcagctggtgcgggccgacatcgtcggccggcgcggcgacgtgatcagcagcggacggatctgccggcacgtgcaccgatgggcggtcgagcacggcgaccagcgtctgctcgcgctcagccacctgcggctgtcgccgtatttcgggcagctcggcgactatccgaccgccctggagcacgcgctcggcgcgaaccgggcgacgtccgcgctgggcggggcggcctcggcgtacctgcgatggcggtgtgccatggcgctcgccgacgcgctggccgacgtcggtgacctggacggcgcccgggcgcggtatgccgaggcggcccgggtgtcggtgatcctgggcgacatccgggcgcggatccgggtgttcaacaacctggcgtacaccgagttccaggccggtgggaccgacgccgcgcaggaggcggtggagcggctgctgcggctggccgccgaccacgagttgaccctggactacaacacgctggacacggtcgcgtcggtgcagctggccgccggtcggtacgcggacgcgatcgccaccctgcagccggcgctggacgacgccttcgccgcggcgtacgaggaggccggctcccgcgcccagggactggtcacgctctgccaggtgtatcggctggccggggatctgaccagcgcgcaggacgccatcgaccggtgccgggcgctgtgcgagagccgcggcctgtccggggtggccgtcgacgtgcgccgcgagcaggcggagatctgggcggcggccggccggttcgccgaagccctcgacgagtacaagctgttccacgccgcggcgatggcgttgaactccggggagcgggacgcccgggcgcagaccctgcacgcgatgtacgaggcggacgaggcccgccgggccggtgcccgggcccgggagctgtccctgcgcgacccgctgaccggcctgttcaaccggcggttcgtcgacgcggaactcccggtgctgctcgcccaggcgatcgagacgcggaccccgctgtcggtcgcgttgatcgacctggaccacttcaaacggatcaacgacacctgttcgcacgaggccggtgaccgggtcctgcggatggtcgccgatctgctcaccggggtggccgggctggcccgggaggcgttcgcggcccggctcggcggcgaggagttcctgctggtgttgcccggcgcggcggcgggcagcgcgttcgcctgggcggaacggctgcgcgaggcggtccgcgggcacgactgggcgccggtcaccggggacctgccggtgaccgcgagcatcggggtggccacggtcgcgcccgatcgggacacccaggaggcgctgctgcgccaggccgacgtgcatctgtacgccgccaaggaggcgggccgcgaccggaccgccgacggctcagccacgatgccggcccgccaggcgtcctgaggccacgcccgccagccggtcggtgccgacgcccgcggtcaggaacatcgcggcgagcagcagccagcccggtgcgccgtgcgcgatcccggtaccggtcaccaccagcggcgcgagcatcgtcccggccgcgaaaccggtctggctgacaccctggtagccacccggactggccggatcggcgagctcgaacgccagcgaccaggcacccgcctcggagagcacctccgcagcgctcgccgtcagcaccgccaggatcagcacgccgaccgcggccgccgccggcaacgggcccgccgcggcatagaagacgcaggtcaggaccaggagaaccgacgagcacaggacggtacgcccggccgtgcgcacgtccgtgaccagacgagccgccggtacctggaagaccgcgaccaggaccgtgttgagcacgagcagcagcgcgaccgtggcggccggggcgcgcgtgtgaccggtcacccagagtggcatcccgacggtgagcaggccgaactggacggtcaggagcccgtagagggcggcgatgacgacgtaccgtccatccttgagcggtgtccgcatcgacggccgggaggtgctcgcggcccgacgtggcggcaggccgcgcagcggcatgatcgaagccagcaccagcgcggacgccgcgagcatggcgatccggtagccggtggcggtgccgtcggcgagcgcggcggtggcggcggccgagccgagcccgacgaagacgttggtgaccacccgcagacgcgcccgcacggtgatcctttccggaccggtgcagtgcagcgcgacgagcgtcgcctgcgcggtccgctgtgcgccctgcgcgccgaccgcggccgcggcgaccacgaagaaggacatcgggttaccggctcggcagtacgcggcgagcgccacgccctgcaccagggtggccgccgcgaggacccgatgggcgccggcccggtcggccagccagccggcgccgaacgcggcggccatgccgcacccgccggcgagggtcaggccgaggccgacggtggccggggacaggccgagcacggaggtgaagaacagcgcgctgacggcgaacaacacccccttggccagcgaggaagcggcgatcgagagggtgagggcacggacgatgggagaagcgggagtcacgcaccggttgtctcaggccccggcgggtggccgcgaacgatgtagcgttccgcttcatggtggtgcggtatcagctcggcggacgggatctcgggcgggtgcggttcgcggtgtcgcccctgcacgagctggtgctgtcgctgcacgcgtggcgcgatccggggcggtatccgctgcagctgccgtggatccgggagatgcgtggggcgatcgacgggctcgacgcggagctcctgatccagctcgtcaatgatgaattgtggacaccggatttcctcacgccgcgtccctggtcgcccctgacccggctggaggacgagtgggaggtggtacgtcgtacgcccgccgtcgttgttgatcgtgaattgcgcgcactgcacggagggttgcccgcggcgttgcgcggagacgacgtgctcgcccggatcgtggacgcgctgaccggatactgggagatctgctttgcgccgcactggccgcggatgcgggcgctgctggaggcggacgtgacctaccgcggccgggagatcgcgcagcacgggctggcccggatgctcggcgggctcgccgggcgggtccggctcaccggcgacaccgtcgaggtgttcccgcgcgcggcgctcgattacacggcgcccgcgaccgacggtctgacgctggtgccgacgatgtggacgaccagcgccgccgtgccgttgcgggccgaccggccaccgatgatcagctatttggcgcggggactcggcaccctgtgggagccgcagccgctgcccgcgcccggagcactcgccgggctgatcggggtgccccgtgccgggctgctggtccagctcgcggtacccgcgtcgtcgaccgagctggcggcgcggctcggcgtgacggtgcccgcggccaaccagcatctgcgggcgttgcgggcagccgggttgctggtcagcgcccggcacgggcggtcggtgctgtatcggcggtcggacctcggggaccggctggtggcgtcctcagccgccggctaggagggcggccagctcggccggccgggtcagcatcggccagtgcccggaatcgatgtcgaccagctcgacgtgcttggcccgggccagctccggcacctcaccggcggcgatccactcccgggcctgatcggcggtgaactcggggcagaccacgaccaccgggacgtcgaagcggcggtcgtcggtgagccggaccacgcccccggccaccgcctccgggaccgggatcgcggcggccgcgaacgcctgccgggccgactcgtcgaggtcggcggagtccggaccgtcgaacgcggtccagccgggaaacggcatgaccccgtcgacgatcgggaagaagtcggcgtacggccggttgtcggcgcaggggaaaccgccgatcagcaccacccgggacacccggccggggcgggcgtcggcggccatccaggccagggtgcaggccgcggaatggcccaccaccaccgaacggccgggtgccgcgtcgaccgtggccaggaccgcggccagctgatcggcgagggtcgccgagctgttgccgtcgccctgacccggcagggtgaccggcaccgggtgacggccccgggccgtcaggccggcggcgacaccggtccacgccgtcgggtcgagccagagaccaccgagaagcacgatctgatccgcattcatggaggcaccgtagaggggattccggacgatccgcttccggtaccgtcctctactgttctcgttgtgccgaccggacccggccccaccgcgcgggccctgcgcaccctggagatcctgcaggcacgtccggggatcaccgccggccgactggccgcgctgctgggggtgaccgatcgggcggcgcggcgctacgtcgagatcctgcgcgaggcgggcataccggtcacctccgtgcgcgggccctacggcgggtaccggctcggccgcgggacccggctgccgccggtcgtgttcacccaggaacaggcactggggctggtgatggcggtgctggacgggcagccggcggccatcgacgcggacgacctcgtgggggaggcgctgagcagggtgatccgggcgctgcccgggcgtgtgggggagcaggcggcggcgttgcgggcctacgcctcggcgacgccggaccggaacgcggtgcgggctgacccggcgatcaccggcgagctggtcgccgcggtggccgagcgacggcgggtgctggtgggctaccggagtgagcgtgggcgggagcaggagaccgaggtcgacccctgggcggtggtggtccggtacgggcgctggtatctgctgtgccactcgcaccgggccgcggccacccgaacattgcggatcgaccggttgttcgcggtcgagcggttggagcggggattcatcccgccggaggggttggatccggtcgcggcgctggaggcgaacctgggggccgggtggaaatatccgacatgtgtgcggttccatgcgtcgctcgcggaggtcgccccgtggatccgggggccgatgggacgcctggaagcggacggggaccggtgcgtgctgatcgggaccacccggaatcccgcgatgtacgcacaggagtggctggcggccattcccttcgacttcaccgtggagggtggtcctgagctgcaggccgcggtggccgcggtcgccgcgcggttcggtgcggccgtctcgccggccgccgcgcccggcgaaaatgtcggggggtcctgagaggatttctcacgtgcagacaccagcgatggtcggcgcggcgcgggagcgtgcgcgcgcggccggattcacgatgtcgtccgaggacggctgcgggcggttgctcgccggggcggtgcggcgcggcgggagatggatcgatctggacaacaccgtcgcggcgtcgacgcccggcggtgtgctgctggtcgacgacctgcagccggagcagtgggggagtgcggatcatgagcggttcaccggtgaggtggcggcggcgttgcgcgggcatccggggctgaccgcggtggagatctcctggagcagtggtgtgatcctgtgctcgcggcggggtgcgtgatggtcgggttcgagatggacgcgggtgcgctcagtgaggacgagcgggctttcgtggcgacgacgcggtcggcgctgtctgccgacgtgtccggattcgtcgggcgggtcggtgggcggctgctcgtgggggtgtcggtcgtcgaccggatccccgggcggcatccggtgaccgtgctgatgatcggcgtgcactacggcgacgggcaggtgctcggcggtcggctggatcacgaggactacgcactgctcggcgaggcgcgcttcgaggcgggcggtccggccggtgagctggggcgcgcggcgggcgagtggttggctgacgtgctgggccggccggtggctctgtactgctggatgcgggacgggcaggcggtcgcctgtcagtaccggttcgcggacaccggcgaggtgctgctgcggtcggggacgccgcggccgggggcgcccgacatcgtggtgccgatccgcggcgatgtctcgggcattccgctgccggtgggtgccgtgctgtccggggagcggccggccgtcaccggggtctggcgggaggggtgatcgcccggcattgacccggcctggccgcgcgggagggagccgggatcgccgcccggcccgctcacgacttcggtctggtcggcgccgtcgcctgcctccacgccgaggcggtcgacgggcgcggcgggtgtcgggtcggtcaagggatgggcagggtgtcgacgtcggccatgacgaccttgcgatcttccgggtcgctgatcctgtcgaccagggcgagggcccgggcgcgggagtcgcgggcggccggcaggtccccggcgatcgcctgggcgcgggcaagagcctcgtgggcgctcgcctgcagccacatctcggcgcccgggcggtcggcgtaggtcaggcaccgctgggcgtggtagagggcgggctcggcccgcccgagagtcgcgtagacccgggagcactgccattcgccgatcgcccggttctggtcgtcgccggcgttgtcccagtggaagcgggaggcgtgcgccatgtggatcatgcggtcgtcctcggcgggggagcgggactccttctcgatcaacgaccaggtgtcgttgaacagggtgcgcgccagctcccgctcctcggtgacggtcggcggctggggtgcggtcatcgccatggtgattcctcgttcgtcgtcgagcaggtggtcgagggagtgcagggatcggcggatccggtcggcacgggcctgcagcgccgcgcggtgccgggtgagcaggcgccgggcctcctgctcgccggccccggtcagcagggcccggatcgcctgcagcgggacgtcgagcgcgcgcagccgggcgatggtgacggcggtcgccacctggctctcggcgtaccaccgatagccgtcggcggagaccatccgcggcacgaacaggcccagccggtcgtagttgcgcagcaccttcgtggtcagcccggcgcggcgggcgacctcgcccaccgacagcatcccggcgtcccgcgttcccatgccgatcacgctacgaggttgccccggggcaaggtcaacaccgccccgcacaccccgcgggcgcgtcggcgtatcgaaacatgcaaagacttgttgacgcgagcgggcggcggtcgtaattttcatcaacaacgaccgacaatgaaaaggatgaccggccgcagggcgggctccttcgctcctgatcgatgagtacccgaggggtaagccatggatgaacgccgctatctcgccgccgccgccgtgtgcgccgcgacgctgctcgccgtcaccgcctgcggtggcggcggcaggtcggccaccggcgacgacggcaagccgaagaccgtgccgaccacccgcggggagggtgcgaccctcaccgtgtgggtgatggacggcgactacaccgacgccaccctcaaggcgatcaacaaccaattcacccaggcgaccggggcccgggtggacctccagatccagcagtgggagggggtcaccaccaagatcagcacggcgctctccaccaccggcaccccggacgtgctcgacctcggcaacacccaggtgcccgggttcgcggccaacggcggcctgctcgacctgaccccgtacgccgccgacctcaagcagggccaccggtggctggccgggctggaggagccggccaccgtcgacgatcacctgtacgccgtgccgggcttcgccggggcacgcgcggtgatctacaacaagaagacctgggcggccgccggcgtcaccgcggcgcccaccacgtacgcggagctcaccgctgcgctcgacaaactcggggcggccaacccggcggccgacttctcgccgttctacctgcccgggcagtactggtacgcgggcatgcagttcatctgggacgccggcggcgacatcgccggcgacgagggcggcacctggaagggcggcttctccagcccggccgggcagaagggcctggccgacttcaagaccttccagaacacctactccagcaaggcttcacaggccctggacacgatcaccccggaccagaaccaggtgttcgccgacggcaagaccgcgaccatcctctccacggccggctcgatcggtctgatccagaaggacaaccccaagatcaaagccgaggatctgggtacgttccccctgcccggcgtctcgggccgagcgcagccggtgatgctgggcggctccgactggggcatcgccaccaagagcgacgccgcggatctcgccctgcagtgggtgaagatcgcgtccagcccgtcggtgcaggacaggtacgtgttcggcaacgacggctggatcccgaacagcaccgagggcatccaggccgcccagcccggcctcaaggagcagcagaagggcttcttcaccgcggcgctgacctccaaggccaccccggccgccgcccagtggcccaccctggagggcgacaagagcatcaaccaggtgttcgccacggtggtctcgggcgccaggtcgccggccgacgccggccgggagttcgacgcccacctggagtccaccctcgccggcggcaagtgaccgtcgtgcccgtcaccaccgtgctccaggacgcggccggcgccacgccggccgcaccacccccgctcgccgcgcgcccggcccgacggcggcgcaccctggccccgttctggctgctcagcccggccggcctggtgctggccgcggtcaccctcgcgccgctcggcttcctgatcttcacctcgttcaccgactacgaccagcgcaccctgttcaccggcacctaccacttcgtcggcgcggaccagtacgccgagctgctggccgacccggcgttctggacctcgctggtgcgcaccgtgctgttcaccgtcgcgatggtggccggcagcgtgctgatcgggatgggcgtctcgcacctgctgacccggctcgaccgcggctggcgccacaccgtgaccgtggtgctgatcgtcgcctgggcgatgccgaacgtggcctccgcactggtctggaactggctcttccagcccggctacggcgtgctcaactgggcgctcggccaggcgcgggtcttcggcgacaccaccgatctcaactgggcacaggaccccgcgttggcgtacaccgcgatctggctcttgatcgtctggcaggcggtgccgttcatcgcgctcaccgtgaacgccgcggagacccaggtgccccaggagcatctcgaggcggcccggctcgacggtgcgggtgaactcgcggtgtaccggatcgtcaccctcaaccacctgcggcccaccctgctgctggtcaccatcctgtcggtgatctgggactacaacgtgttcaaccagatctggctgttctcccgcggcggacccggcgacgacaccgccacgctcggcgtcttcacctacaagacggcgttcgtcggcttccacatcggtcagggcgcggccatctcggtggtcaccacggcgctgctgctcgcgctgaccgccgtctacatccgtggcctgctccgctcgggggaggacctgtgagccaccgcggacgccggatcgtcaccaccctcgcggcggtcttctgcctggtctggatcttcccggtctactggatggtcaacaccgcgttcaagccgcgctccgaggtgagcacgaccaccccgcacttcgtgccgatgcacccgaccctggccaacttcagccgcgcgctgggtcaggaccagtttctcaccaacctgcgcaacagcgtcatcgtggtcgcggtgaccgtgctgctctcggtcgtgctgggcaccttcgccgcggccgcgctgtcccggttccggttcgccggccggcgaaccgtcatggtggtcatcctggccgtgcagatgctgcccggcaccgcgctgctgatcccgatgttcgccatgttcaacagcgtcgacctgctcggcacgtatctggcgctgatcctcgcctacgtggccaccgtgctgccgttctcgatctgggtgatgcgcggcttcttcgtcgccgtcccggccgaggtcgaggaggccgcccacctcgacggcgcgtccacctggcggaccctggtcagcgtgctgttcccgctggtcgccccgggcgtcatcgcgagcagcatcttcgcgttcatcgccgcctggaacgactacctgttcgcctacacgttcatgcaggaccagagccggtacacgctgccggtctggctggcgtcgttcagcaatccgcacaccggcaccgacttcggcgggcagatggccgcctcggcggtgttctccgtgccggtcgtcgtgttcttcctgttcatccagcgcaacctggtcgccggaatgtccgccggcgccgtgaagggctaggtccccgccttgctgatcccacgccccctcgccctgaccgcctcgccgggagagttcgtcctggaccggaccacgaccgtcgcggcgcccgagcagctcggcggggtgctcgccgcgctgtggcaggcgctgcgcgcggccaccggcctgcccctgcgcgaagcgcggcggggtcccggagatcgagtcgcccggccacgcgcaggccgcgccggccggctacccccacctcggggtcaccggacggtcgctggagctgcacacccgtccacaacgcacagacgatcaagcggtggccgtcctcgttcccgcgggatcggaggtcacctcacgaatggcggctgccgtactagccgggggccggtttgaccggcagctcgatggcgaaggtggtgcccgggccgctgtggtccgcgagggtgatggtgccgcggtgacgttcgacgatcgcccgggcgatgaccaggcccaggccggtgcccgggatgcggcggtccagggcggtggaggcgcggtagaagcggcggaacaaccggggccgctcggccgacgggatgccgatgccggtgtcggcgacggtccaggtgaccgtctccgcactgtcgtccatcgcggcggtcacggtgaccgtcccgccctcgggggtgtatttgacggcgttcgacagcaggttgtcggcgacctggcggagccggcccgggtcggcgtacaggtccaggcgttccggcagccgggcgacgatcgtcaggtccttgtccgcgggggtgaccgcctgcaacgactgccggatgatctcgcacaggtcggtgccgacggggctgatgcccaggctcccggactccagccgggccagatccagcaggtcctcggccatcaccgacaggcgctcggcgttccgggtgatcatccgcaggtagtggtgccgctcgtcggggctcaggtcgtcgatctcgtcgtcgagcaggctggcggtgccggtgatggccgccagcgggctgcgcagctcgtgggtgaccatggcgaggaactcgtccttggtacgggccagctcgatggtcagctcctcggcgcggcgccgctgcacgtactgcccgatctgggcggcgaggccgctgagcagggcgatcagggtgtcctcgggatcctcgacccggttgccgtagacgcagagggcgccgaacacgtgctggccggtgcagagcgggacgccgacggccacccgcaacccgatgcgggcgccggcgcggctgcgcagcgaaccggtgtcggcggtcaggtcggggatccactgcggagtgccctcggcgcagacccggccgggcagcgcgacgccgagctccagcgtgtcgacggcgaagttgtgcagccgccggcccggctcgacgtgccgggccagacagttcagcagctgcctgtcgtcgtcgaccacccacagctcggtcaccggccagcccatcttcacgccgagggcctcgaccacccgctcggcggccgtgtcgctggagtccgcctcggcgagcccgcgggcgacggcggcctccaccgcggtgaaccggccggcccgatgctcggcggtgatgtcatgggcgaagatgtggaacaaccggccggtggccgagtcggtggcggtcagcgtcatctcgatcggaatctcgtggccgtcggcgtgccaggcggaccattgccgccgccggttacgggtctgccccggctggccgctggtcagcaacgcgagctccgcccggccggcctcgcgcgccccgggggccacgatcagctcctcgatcgagcggccgaccgcctgcgcccgcgggtagccgaacgtcgtctcggcggccggattccaggccaccacccggccggtggcgtcgaaggccaggtaggcgtccagggcggcggccagcacggcctgggagtcgggtatttccgtgtccgctgacatcagtcacccccggtggttttggcggacgccgatccgggggaaacgggcggtgcggctctctccaggctaaccgggtccgctgcccgcgcggcgtgttgcagaacttttccgggtacgggctctacgatcgcacaaattgtccggtaagtcctaatttttggtggtaaaagtgccggaactcgacgtcgcggtgctgacttcgccgcaacggctgcgagccgtggcgagcgcacgccgggagttgccggtcctgccggtgccgctggacggcatggcccggatggcggcgcggatgctgcggacgccgatggcggtcgtcaccctggtgcagggcggcgaggaggagttcctcggcctgttcggactgccggagccgttcgccgccacgcggcgcgccgcactgcagttctccctctgcgcgttcgtggtctgcgccgacgacgtggtcgcggtggacgacacgctcgccgaggaaaggttgcgcgagcatccggtggtccggcagtggggggtccggtccttcgccgggatcccgctgcacgacaccgacggccagccggtcggtgcgatcaccgtcatcgacatcgcgcaccgctcctggaccgcgccggacctgacccggctcacgtacatcgccgacatgctcggcccgatcccggcgggcaccccgtccgccgaggcggccatggacctgctgtgcaccgaccaccgcggcaccggcccgcagccggccgccggcgtcgcggcccaggcccaggtgcagcaggcgttcatcgaggcgctgctcgacagcctgcaggtcggcgtggtggcctgcgaccgcgatcgccgcccggtcgtggtcaaccggatgatgcggcacctgttcggcctgcacgacggcatctcccgggaggaggcactgaccgccggcctggcccgcgtgcaccacctcgacggcactccgatcgcccccgacgaactggtggtgacccgggcgctcaacggcgagacggtgcgggacgccgcatcgatgctgtgcacccccggcgcaccggaccgctacctgttggtcaacgggcaacccctgcacgaccacgacggcaaccgtctcggcgcggtctccaccgtcctggacatcaccggccggcgccgcaacgaacgcttccgcgactgtcagctgcgggtggcgcgcatcctcaacagcagcgacacggtggagcaggcggcaccgcggctgctgtcggccgtcggcgaggcgctgggctggcagcacgtcggactctggctcatcgacgacgtcgccgacgtcgcccgcccggccggccactgggaggcccccggcgtacacatcgaggatctgatcccgcaacggctcacccgcaacgaccccggcctggtcggcaccgcctgggccaccggccggccgatctggatcgccgacctcgccacgaccacctccaccgacccgcggctgcgtgacttcatcgccgccgccgtccaccgcgacctgcggaccgcggtggcgatcccgatctgcgagaacgacaccgccctagccgtgctcgtctgcctgagcgccctcggcgagcacgacgacgcgccgctgatcggcctgctcaccgacatcgccgaacagatcggccggctcctggcccgccgccgggccgccgaactcgacctgcagctggccagcgccaaggacgacttcctcaccctgatcagtcacgagctgcgcaccccgctgaccacggtgctggcctgcaccagcatgctcgccgacgacccgcaggtcgacccggacacccggcagatgctggccacggtcacccgcagcaccaccgcggtgcaacgcatcatcgacgaactgatcgacctggccggcatcgaatccggccaccacccgctccacaaacgcgccaccgacctggtcaccgtcgtcaccggcgcgctcgccgccgccccacaccccgacgacatcgagatccacaccgatctgccgccgtccctggtcgtcgacggcgaccccggccggctgcgccagatcgtcgaccatctgctgtccaacgcgatcaagtacagcccccgcggcggcgacgtgcggatctccctgtccgccgaccgcggcgacgtcgccgaactcgcgatcaccgacaccggcatcggcatccccgaagcggaccgcgccggcctgttcacccgcttccaccgggccggcaacgcccggcacaccgccgtcaccgggaccgggctcggcctggccctggtccgggcgctcgtcgaagcccacggcggcaccgtcacccacgacccggcgcaccaccccggcacccggatcaccgtgcgtctgccccgctgagccggccggtgctcgcggtcccgccgaaggtcaggaccaggtgatctcaccgtgccggtcgacgaaccgaccggaaccgtgccccggaccctcggtggccagcgcgacgatcgcgtccgtgccctcggtgaccgtctgcgggccgctgttgccgttgaggtcggtggccgtgtagccgggatcggcggcgttgatccggatgccgggcaggcccttggcgtactgggtggtcagcatggtgagcgccgccttcgcggacgtgtacgcgggagccaccacacccgcctccggtcgtgccgggtcgtgggtggcggccagcgagcccatcgcgctgctgacattgacgatcaccgggtccggcgagcggcgcagcaggggaaggaacgcggtcgtggtgcggaccacgccgaacaggttgacgtcgaagacgcccagcatgtcggcggcggtcagggcgccgggatcgccgaccggcccgtgcaccccggcgttgttgatcaggacgtcgatcgagccctcgtgctgttcgacggccgccaccgcggcggccaccgacgcgtcatcggtgacgtcgatctggacgaaccgggcgcccagtgccgcggcggtcgcggcgccgagcagtggatcacgggcgccgacgatgacggtgtgtccgagttcgagcaggcggcgggcggtctcgcggccgaggccccggttggccccggtgatgaaggtgatcgtcatggcgtcgatgattcgccgggcggcccgacggcagccagggacgtcgcgacggtaggacgatcagtaccaccctcgtggcggtgcggtgcgcgacgatgggcacatgacgacggagggggcagggctcggcgcgacgatccgcgcctggcggaaccggctgtcgccggccgcggcggggctgccggcccggcgggcgcgccggaccgccgggttgcgccgcgaggagctggccgagctggccggcctgtcggtggactatgtcgtccggctggagcagggtcgggcgaccacgccgtcgtcccaggtcgccgcggccctggcccgggcgctgcagctcagcgtcgcggagcgggaccatctgttccggctgtcgcgcctggcgccgccggcggacgaccggatcagcgaccacatcccgccgggcgtgcagcgggtcgccacccggctcggcgatgccgccaccgccatcttcgccgccgactggcagctgatctggtggaaccgcggctgggccgccctgttgggcgatccggcggcggtgccgccggccctgcgcaacttcgcgctcgacacgttccccacggcgcccggcgcgacgccacggctgtcccgatggcccgtcctctcccgcgacggcgacgccacgaaagcggcgatcgtggccgacctgcgcggagccaccggccgtttcccgcgtgaccggaggctggcgcatctgatccgggacctcaccggcggcaacccggaattcgccgagctgtgggcgtccggcgcggtcggcgcccatcgggaggaccgcaagaccgttcaccatcccacggtcggcccggtcacggtcgactgtgatgttctcagcggcggggggaccggcctgaagatcgtcatcatgaccgccacgccgggcagtccggacgagacgaaacttcgcttggccgcggttgccggctcgcagctggaggactcgcaccggtagcaacggccgaacccccaccggggcgcccggccggacgccggtcaggccgcggaggaggaggtggcgcaggaaccgatctccgccttgagggacttgatcgaggccgtggcactcctgaccttcgccgtcccctcctcgatgagcggtgtcgccgtgtcgtagtcgccgtcgatcaggtaggacatcgcctcggccgtcagcttccccgcctccgccagggtctggcccgccgtcaggaggccggtcaccgcgtgctggcagtcgccgatctgactggatgccgagctcagcttggcctgggcggatttcagctcactcctggtcgatgccaggtcgtcattggcggtctgcagatcgtccttcgtgctcgtcaactgcgtctgggtactcgcgagctcctgctcggtcgcgtgcttctgctgggcgagcacggtgctctgcgcgacgagaccgttgttctggtccgagagcctgccgttgtcgcccagggcgcccgtgtacagaacggacagcgtgacaacggctgccagcgccacgctgccgaggccgatcaggaacggccgcttctgatacaccttgagcggctcggcgctgaccggtgtgcggtagggcgcagcgggggcaggcgactcatcgacgaccgagtccagatacgtgtacacgacagtggtgcctctctagcgactgatgactgcctgcccgcttaccgttgcgaccagccggcgttccggcagcacctccagtcggcggcgcgaaccgccagttgaggcttcccccgaggactcgatcaggggaccgccggcgccgaggcgcccgagccgcggcagacgctgaccgccgggacgagaccgggcacgcgccgcggcacggatctcaggtggtggcgacgaactcacgcaggtgggcggcgcaccgggtgggctggtcctccgggatgagggtgaacgcgtccgggacctcgaccagccggccccgcggcaggatctcggcgaggcgggcgccgttggccgcgcgcatcatccgggactccggcgcccacaggaccagggccggatggtcgacagtggacagcagcgcggccgcgtcgagatactcggcggccctcgtcgtacgcaggtatctgtgaagatcgcgccggatcggccgggaggtgcgggacggccgcaaccaatcgtccatgatgtcggccgggaccgggcgtttcgacatgaggccgaagttcatcggggagcggcgcaggccgcggatccgcagcgtctgcagggccaggaaggtcgcgccggggatcctcgacgactggtggagggccttgccgggcaggccgggcgggaaattgtcgaacgactcctgcggcagcagcaccagccgggccaggcggctgctcaaaccgtacccggcgaccagctgcgcgccgccccagtcgcagccgatcagggtcaccccgcgcaggtcgagggcgtccaggaactcggcgaccaggccggccaggccgcgggagctgaggtcggcgtccgggttcatcggcaggcggtgggcgcccagcggcacctccaggacgacacagcggtgatcggcgcgcaggtcggcgacgacatgccgccagagggtcgctccgaccaggatgccggtgaggaagaccagaaccgggccggcgccaccgctgtcgtcgtactcgacggtgccggagcggagagggacggtacgcatcggcgagcccccgttcgtcaccgccgacggtaacccgcccggctcagaaaagcgcggtctggcccgggatggggtcgcggcggccggacatcgagccgtgcagaacccgcggcttgagggtggcggcccaggcgggcggcggctcgggcggctcctgctccagcagcgacggcgccggggcgtcgccgcccaccagggcccacagcgacgggcccaggttgatgccgtgctcgcgcagggcgcggcggatcaccaggtagtccagcggcagccgggctgtctccaggctgggcaccggcaggtcgtggcgcatccgcatcagtcgcctgttccggtcgacggcctcccgggcggccggctccagcaacgccgtcgcggccagctcgccgaccgcctcgcggagcgccgcgacgtcggcctgccacgccgcgtcgaccgaaccgaacgcggtgagcaggcgggccgcggtgcgagccccgaaacggcgtacgccgggaaggttgtccgaagggtcgccgcggagggcggcgaagtcggtgtactgccacgggtgcacgccgtacgccgcggccagcgacgccgcgtcgaccaggaccgaccggtcgaagccgccgttgcggatgcgcaacaccgaggtggtgtcgtcgatcagcgcgaacgcgtcccggtcgctggtcatcagcaccgactgccagcccagcgagcgggccagggcggcgctgctggccaggacgtcgtccgcctcgtaggccggcggcacgaccgtgccgactcccgcggcccgcagcaggtcgggggcgatctgcagctggcgggtcagctcggccggtttggccgggcggtgcgccttgtaatccgggtggtcggtgcgccgggccgaatcgtgcgggcagtcgaagccgaccaggaccgcgtccggccgaagctgggcggcggcccgcgcgagatagccgaccaggccgcgcagcgccggcgccggctccggcgaaccgtcactggcgtggtaggcccggtgcaccaggctgttcccgtccagcaccagcagcaacccacccgtccgcgacaccctggaagtctgccacccggcggggcggaatccaaaggtcagcggcgcaggtcgtgcctacggtgggtgatggtctcgaccaggcgggcgggcaccaggcggcgcagcgcgaagaccagcggggcgttgctgcccaccgcgtaccgctgccggggtctctccgcctcgatcgcggtgaggatggtcgcggcgaccgtctccgcggagatgccggccttctcgttgcgatccagcgcggtcagcatccggtcgaagtccgcccggtgcggcgaaccgtccgccacgtgcctggtgcgccgctcgctgatcccggtgttgatcgagccgggttcgacggtggtcagccacaccccgaacggcgaatactcgtgccgggccgcggtcgcgaaacctttcacggcggccttggtcgccacatacgacgaccggtaggccagcgggaacgaggccagcatcgatccgaccatcaccacccggccgtagccgcgcccgcgcatcccgggcagcgccagctgcgccagccgcaccgggccgagcacgttcacctggaacagccggcgcagcgcgtccatcggcagctcctcgaacgggccggactggctctccccggcgttgttcaccaggacgtcgacgccgcccagcagatcggcgagcgctgcgatcgaggcgtccgaggtgagatcgagggcgacatattcgacaccggccgcgggctgggtcaccgtggccgggtcgcggctcgtgccgagcactcggtaaccgcgcttgaccagggcggatgcggtggcgaggccgatgccggaggaggctccggtgaccagggcggtgcgctgcaccgaaacacgatagcggccaagatctgccgaacgctacagtgcgcgtgccctatcgcctgaaacggggaagaatcactgtgaagctcatcaagacgaccaccgtcgcggtggccgccggcatgctcctgctcggagggtgcggcgacaagaagaccgacgcgccgaaggcggacgccaccaccacggcctccgctgccaccgacctcaccgcgctgtccgccgacgagatcctgacccgagccaccaaggcggttcacgacgccaagtcgttgcacatcaagggcatcgagaacggcgagggcggcgagaagatcgcgatcgacatgaagcagtccgggaagaacgtgctgtctcggttgaccgtcaacggcatgaacgtcgagttcctggtagtcgacggtgtgcagtacgttcgtcccgatgcgaagatgtacaagacgctgaacctcaagttgccggcggccgtcaccgccagactggccacgatgtggatgaagccgaccgccggggacagggtcttcgccccgatggccgagggcatgaccatggacaatatgctcaagccggacggcacggtcaccaagggcgagaccaccacggtggacggcaaacctgcgatcgccctcaagtcggccgacggcgatctgctggtcgcgaccaccggcgagccgctgccgctgaaactgatgggcggcaaggacggcggtgccatcaccttcagcgagtacggcgcggacttcccggagatcaaggcgccggccgcgagcgaggtctacaacctcccgaagacgagctgaccacatggtccggtgcgggtggtgcccgcaccggaccgcgattgccgttgtacgttcagagcgtgaccgtcctccccccgatggtcaccaggagccccccggtcgcgctgaacgaccaggccagcgccccgctgtaggtcgcgcaccgggagccgttcgtccccgaccagaactggttcgagctgtccgagtcgccgatgatccggtcgttcgtgccactgctgaaccggcacgacgtgttgttgcggaacaccgacgtaccgccgtcgaagttgaagttgcgtgcgccgttgtcgatgctcaggttgttcgagatggccagcgaaccggggttgctgttgaacgtgaatccgtgcttgccgttgtggtaggcgatgctgcgccgcacgatgtggtcgaccgcgatgctctcgccgcccagcttgtaaccgttgcggtcaccggcggcagcctgggtgccgtcggtcagcgtgccgttgtcgtacgacagtgaattctcgatggtgaccgggccgatcgggccggtggcggtcttggtgaacagatcccagccgtcgtcgatgttgttgtgcgacaccgcgtagcggaacacgttgccggtgccgacggtcagtttcgccgcgaaaccgtcggcgttctcaccaccggcgtccacgttgtcgtgcgattcggagctgagcaccagattgttcgacggccactgggcggccggcgtgtccgatgcgatccgggagatctgcagcccgctgtcccggttgaaccgggtcaccacccgctcgatggtgttgttgctgccgccgacgaagacgccgttgtcgccggcccgttccaccactattccgtacaggtgccagtaattgccgttcagcgtcagcccgcgattcgccggattctcggtctgcgccgagaaattcaacaccggaacctcaccggggtacgccgagagcgttttcgccgcggccgccgtaccgttgttgccgggcgggatcacgaccgtctgcgcatagctgtaggtgccgccgcgcagatagatcgtgccgcccgcgccgatccgtccgatcgccgaggtgagcgtggtcggcgaggacaccgtgccggccgccccgtcggtcccgttcggggcgacgtacagcgccccggtcaccggcggcgtgctggtgcccgggctcggcgcgggactgctgccggacggggccgggccgccgctcgacggcgtcgaggacccgctgtcgtcgaccacgatgtcgtcgaaccggccggccgcgtgctcggtgagcagtccgatccgcccgccggcgatcgacgggtcggtgacgctgccgacgctggtgccgttcaccgtgccgctgatcgtggtcccgctgaccgtcagccgcagcgtgtagaaggtgctggtcgagatggtctgggcgaggctggccaggaccgtgacggcaccgccgttcatcgcttccagctgcacccggttcgacccggtcagcgacagccggtacatcctggtggcgccggccgcccgcgcggtcagcgcgaccacgccggcaccggtgccgaacgcggtcgccttgacccgcgcctgcaccgcatagtcggtccacgagccggtgccgccgaactcgcgggcccgctcgctggtggtgtcggactgctgcagcaccttcgacccgtcggtgacgatcgaccaggtgccgcccgacttcgaccagccgccggtcgacccggactcgaaatcggcgctgaacagtgtcgccgcctgcgcggtggcgaccgtgacggcgagcccggcgatcaccgccgcggccagcgcgccggcgccggccaggcggcgggcccggcgagcgcgtggggatggggacatacggatttctccctgtcgagaatgagctcccgccggcaattcctcgcgcagcacaatgcaatgcgcggcctgggcccggggatgggaacgccggccggtatcggggaacgaactgttaccgcaaccgaatctcccaccggcgtgagagccgcgtcaacgattctcatttgcaggtttgttgcagaaacgcgggcgccgggccttcccccgatggcgggcgacaccaccggggtcgccccgctcaggacgccgaagcccagcggcggacgctccggctcgttctcccaccggcgccggctggcccgctggtgcgaccgtcagcggtcacggcaccggccggggtcctcaagccaggcgatgacggaccggacgaagccgtcgacgttcgacaggggtcggccgcggaggatcgcgtggaggtgcccggctccgacggctgcgtcccacgccccggcgcgccggtagatctgctcgtcggtcgccgcgcggagcatgtgccagccgtgccaggtcgcgaccagcgccgcgtcgatcgccgggtcggacaggatcgccatgtcccagtcgaggaccccggtcagtgtgccgtccgcgccgaaatggacgttgccgccgccgaggtcgccgtggacgaggctggccgggacctcctcgatcgccagaagttcgtctgatcgctgccggaccctgtcccgccacctcgccggcagccgtggtatgacctggttgttcaggatgtcggcccagcctgaaccgtcatcggcgcgccggcgtggccggtggagcgcggcttcgagctccggcgagatcctcacctcgcggagcgcgtccagtagcggaccgaacaccgtcggatctccggtgccttccggcagggacgcgccgtcgatccaggagaccgcgacggccgcccgttcgccgaaggtggtgaccgcggtcatcggctccggcacggcgaacggcatgccggccgccgcgacagcgtgaagtatgccgacccggcgcggcaactcggcggcagcaccggcccgcttactgacgcgcacagcggcgatgccgggaagcagcaccacgtggtgcatgttcccgtgctcggcgaggcgtgcggagtcgagcggggcgccggggagcagcgcatcggtgatttccagtaggtcggcggggaccggtcgggacatccggcaattctgtcggacgccgcatccgggagcgggtcaggccaccgatccgggcagcaggtaccggtagtcgcagccggcgaggtcgggtgggaaagggcgcattcagccgccggcccttccggatcgccggacgccacctttcacgcagcggtcgcagactccagggacaggatgaagcgggaaccgccggacgggttcggttcgtggcggatgtcgccgtggttggcctgggccaggccgcggacgatgtagagacccagcccggtccccttcaccgtggtcgcgtcgcggtccgcccgggccaggcgttcgaagagccgcgaccggaattcgccgggcacccccggcccgtcgtcctcgacggtgatctccacctggccgccggtctcggcgacgcggacggcggtggccccaccgccgtacttgcgggcgttggacagcaggttcaccaggatctgctgcaggtgcccggggtggcagagcacgacggcgtccggtccggacaccggcaccggttcgctgccctgcgccgcccactgggcgcggtcgatctcctcgcgggcccgcagcgcccggcgatcggcgcggatcttgccggactcgatggtgaccatggccaggacctcctggacgatctcgtccagtgcgccagcctgccgggcgatcgcctcgatggcccggccgcggcggtcgtcggtgagcgccggccagtcgtcggtcaggatttccgcgttgccgcggatcgaggtcagcgggttgccgatctcgtgaccgagcatgccgatgatgtcgagtttcagctggttggcggcttcgagttcggtgttgcgttcggccagggcggcggaggcggcgtcgcgggcctgttcggcggcgcggcgggcggtgatgtcggcgagcaccccgacgatcagtttcgggtgcccggccgggtcgcggaccagggagatggtcgcctcgaccggcacccagtgtccgtcggcgtgggccagccgggcctcggtggtgtaggactcgctgtcgccggcgaacaggccggccagcaggctccggtgggtgaccaggtcgtccgggtacagcagctcgtcgtactgggcggggagctcgtcgtcggtgcggccgagcatggtggcgtacgcccggttggcgcggatcagcgcgccgtccagggcgacgatgatctggccgacgccggtgttggcgaactgggcgcgaagccgctgctcgctttcggccagggcctgttcggcggcccgggcggcggtcacgtccgagctgacctcgagcacctgcgcgtgatccgggtcgaggtggtgcaggacctgacggctgagcacggtgaccgtccggccgtccgcggtgatgtggtccagctggccgttccagtaaccgtcgcggctgagcgcctcctgctgctcggccacgctgcccccgtacgggaaggtggtgtgcagcaaccggtgggcccgcttcccggcggcggcgggcagcggccagccgtagagacgcgtcgcgccgtcgttccaccagcggatcgtgccgtccgggtcgcggacgaccacggcggccggaatcaactcgaagagccgggccgagcggcgcagctgcgcgtcgacctcacgggccgcggtcacgtcctcgacctggatgacgacgtagcgggcgtggtcgtcgtcgttgacgatcagcgcgacccgcagcgccacccagacggtgtggccgtcgcggtgcacgtagcgccgctccatgccggccgattcgatctcaccggcgatgaaccgccgcgcgtagtcgcgggtgctcgccacgtcgtccgggtgggtcagctcggcgaacgtcatctgccgcagctcgtcctgggtgtatccggtgatcgcggtcatcgccgggttggcctgcaggtaccgcccgaagtcctcggtgcgcaggctgcacagggtgaggccgagcggcgagttgtcgaagatcagccggaaccgccgctcgctgatctccacccggcgcagcgcctcggcattgcgggtggcgtcgtcggcgtgccgcagcgccgcgctcaggctgtcggcgagcagggccagctgctgctcgtcggtgtcgtcgaagacgtgcgcggccgcggccgacaccttgaggacgccgatcacctcgtgttcggcgtgcagcggcgcgatcagcatgctgccgatacccagtttggcgcacatcgcctggttgacccgcgggtcggtggtggtgtccgggcagtgcgcgggcgcgtcggtgctcagcgcgatgccgctgagcgacccggaccgcgggatccgggtgccggtgaacggggtcagcgtgccggcggtggccacgtacgccagctggtcgccgtcgatcagctcgaccgcggccccgtcggcggccgggaacagttcgacggcccgatcggcgacgacccgtaccgccgccgcccggtcggtggccgcctcggtcaccgcgcgttgcacggccagggtggcccgcagccggcggacctcgcgttcggtgctgcgtccggcggcccgttccgcggtgacgtcgagcagctggatcaccacggtggccgggccgttctcgtcggtgatcaccgacgagtgcgcggtgaccaccagcggggtgccgtccttgcggtgcagcaccagttcgcgggcgccgcgcggatagtcgccggcggccatgatgtcgaggctgcgctccaggtcggcgtccgggccgccgagcagcacctcgaagtgcatgcccagcgcctccgcgtcgggatagccgaagagcaggcagaacgccgggttggtgagcaggatccggccgcgtctgccggcgcgcaggccgagcacgatccgggcgatcgggctgttgtcggcgacctcggcgaactggcgttcgctgcgggccaggcgttgctgctcacgttccagggcggccagcgtcgcggcccgcgccgcggtgttctcggcgtgccgcagcgcgctgccgatcgaatccgccaccagggtcagttgccgctcgtcgccgtcgtcgaacgcgtacggccggtcgctgccgaccatcagcacgccgaacggtccggcgccgggtgcccgcagcggcgcgatcaccagcgagcccatcccggtggcccgggcgatcaccgggttgacccgcgggtcgccggcggtgtcgtcgctgcgcacggtgccgccggaggtgagcgccacgccggccagcgactcggtgaccggcaccgcgggcagcgtcatgccggcgtcggccaccgggcgcagcatccccgaatcgtcctccagcaggtgcaccgaggcgctgcggccggccgggatgacctgcaggatccggtcggcgatcagccggaccagggcgtcccggttctcggccaccgcgttgatctcccgctgcacggtgatcgtggtgcgcagccggccggcctcacgcgcggcggcctgctccgcctcgaccagcagttcctggctgcgccgctcggcggtcacgtcggcgagctgggcgagcagttccagcggggcaccggactcggcgtgcaacggggtgaccgtcagccggcaccagaggacccggccgtccttgccgacgtaccggaaatggccctcgaaacccggtcgcgcgccgcgggccaggtcccgcagcatcgccgcgcagtccgcccgctcgtccgggtgggtgagcccgcccagggtgagcccggccagctcggcgccggtgtagccgaggatcgcggagaccgccgggttgacccgcagccacgcgccgtccgggtcgagtaccgccatcccgatcggtgacgagtcgaccagcgtgcggaaccgggcctcactgccggccagcgccggtcggctgctgctctcgacgatctcggcgaccaggcgggggtggtcgtcccgatcgtggaccagcacgttctggctgacgatccacacccgcgagccgtcgcggcggatcagcacccgctccatcgccatcacgctcagctcgccgcgcaccatcgcggcgaacagttcggtgaccgggcccaggccgtcctggtcgagaagcatcaggcaggactggccgagcagctcctcacgcgggtagccgaccagctcgcagaaggcgtcgttgaccgcgctgaactgcccgtactcggcctcggtgaggctgagcaccagcttcgggaccggactgcggtcgaaggcgcgggcgagcagctccgtcggctggtcgtccagccgcgcccggtgcccgacattcataccgtcatgatcggccgatggtgcggaacaatgagcgcccgtattttgtcctaggacataactggtagggtgcgcggtgtgatcgaggggaacaccgccgcggagatcgccggctcggtgcgcgcgctgatccagaccggggcgctcagcgagggcgacgcgctgcccgccatccgcgacctggccgcccgcgccggcgtcaaccggaacaccgtcgcggccgcctatgcccagctcgcggccgccggggtggtgcagacgcggcgtcgcggcggcaccgtcgtgctgggcgtgccgcggtccgcgggggaggggcacgccgcctccgacgccgcgatcaatctggcgagcggcaatccggaccgcgcactgctgccctcgcccgcggcggcgatcgcggggtacgcggcgccgctctacggcgagccggaggtcgacccggcactggacccgctggccgccgacggcattcccgccggccatcgcctggtgctcacccacggcgcggccgacgggatggaacgactgctccacctctacctggcgcgcggcgaccgggtcgcggtggaggacccgggatacctggccgcgatcggcatgctgcgggtcaacggataccgggccgccccggtgccggtcgacgcggccgggatgtcggcggccgggctgcgggcggccctcgacgccggcgcacgggcggtgatctgcaccccccgcgcccacaacccgaccggtggtggcgtcacccgggagcgggctgccgagctgcgggcggtgctcaccgcgtacccggcagtcacggtcatcgaagatgatcatttttcgatgatctcggcgcggcggtatcaccggatcacccccgagggtcacccgcgctgggcggtggtccggtcggtcgccaagttcctcgggcccgacctgcgactcgccctggtccgcgccgacccggtgaccgcggatcggctcgccgcccgcctggcggccggctccggttgggtcagccacctgctccagcactgcgtcgcccggctgtgggacgcggtgccgttcgaccgggtgcgcgacacctatgcggggcggatccgactgctcaccgacgcgctgggcgagcgcggcatcggtgtggacccgcgcaccgacgggctcaacgtgtggatcccggtgccgtccgaggccgaggtggtcgccgggctggccgcccgtggctgggtggtccggcccggccgggacttcgcggccggcggcgccgtcgcgccggccatccgggtcaccacctcgaccatcaccgcggcgcaggccaccggtttcgcggccggcctcgccaccctcctctgaaaggctcgccaccatgttccacgggctcagcgccttcccgctcacgccgatcgccgacgaccgggtcgacgccgacgcgtacaccgggctggtcgcccggctcgccgccgcgcgcgtcgactcgatcaccgcgctcggctcgaccggcagctacccgtacctgacccgggcggaacgcgccgcgacggtgcggctcgcggtagcggccgcggcggacatcccggtcttcgccgggatcggagcactgcgtacgtcgcaggtgctggccgccgcggccgacgcccagcaggccggcgcggcggcggtgctgctggcgccgatgagctaccagccgctgaccccggacgacgtgtacgggctgttcgaggcggtcgtcgcggaactgtcggtgccgctgatcgtctacgacaacccgggaacgacccacttcaccttcaccgatcagctgtacgcggacatcgccgccctgccgcgggtggcctcgatcaagattccggggccggcctccgccgcgcgggtggccaccctgcgcgggctgctgccgccgcacgtggcgatcgggatctccggggacgcgcacgcggcggccgggatcgggaacgggtgcgacgtctggtactcggtgctcggcgggacgcttccccgggcggcgcagtcggtgctcgccggcggatcggaccggctggcgccgctgtgggacctgttcgcggcgcacggaagtctgcgggtgatggcggcgatcgccgaacagctggggctcgcccggcgctcctgcctgccccacccgctgcgcgggctcgacgacgcggcccgcacccgcgtcgccgccgtggtggacgcattggacctcgccgggtgaccggtccctcgcccggtggcgtgctcgcccggcgcggcggtctcgcccgctacgtcctggccgccaccatggcccggtcggccgacgggggccgggcggcacggtggggccgaccgtcgtggccgcggtctcggcgtggtccggcccggccgcggcggcactgctgctggccggggcgaccgcgctggccgcggtgctggtgcggatgctgctgtacgcgccgcccgccgggacgccgtccgaggtgccccggcccgggcggacactgaccctgatggtccggtcgggcaccctgcgacgcaccctgtacctgaccgtgacggtcgccttcgccctggccgcgctgccggtcaccgcggtcgcggcggcgccgatgtaccgggtcgccgcggcggcggccggggtgctgaccgccgcctacgggctcggcaatctcgccgggtcggcggccggggtgctgaccgccgcctacgggctcggcaatctcgccgggtcggcggcggaccgcaggcttgccagacgcgtaacctgatggttacgcttccggtgtggacgaggtggccggggcgatcgcggatccggtgcggcgggagatcctgctgatgctgcgcgccaccccgctgaccgccgggcaggtcgccgaccggtttgcgatcagcaggccggccgtgagccggcacctgcgggtcctgcgggaggcgggactggtccgcgacaccgtcgagggccgccggcgggtctacacgctggtcaccgagccgctcgacgagctcgccggctggctcgcccggctgacccgcccgtccggctggcagcaccggctcgacgccctggagaccgaggtgcaccgcacccggcgcgagcggcgcgccgccacacccgaccgttccgcgaaggagtccgcatgagcccgaccccgaccggccgtctcctcggcgacgacctggtgctgacccgcacgttccgggcgccgatcgacgacgtctgggccagcatgaccgaatccgatcgcaccgcccgatggttcggcccgtggcggggtgagcccggcccgggccgtgtcatcaaggtgcagatggctcacgaggagggccggccgtggatggacatgaccatcgacgcctgcgagccgccccgccgcctcgccgtctgcgccggcgaggagaccgaccgctggcgcctggaaatgaccctggccgaggccgccggcgtcaccaccctcaccttcacccagcacctcaccacgctggacggtgtcggcgaggtcggccccggctgggagtactacctggacgccctggtcgccgcccgtgccgacgcgccgatgccgagcttcgacgactactacccgtccctgaaggagcactacgagtctcagcgctgaccgagccccttcagggcacggtccagggtcctgaagaccgtgcccgggccgcccgcccaggccggcgtggggtcgggctgcccgggtgccggctcgtacagccaccagaggttctgccagggatcgagcatccgggccagggtccgctcaccgtagaacggcgtcggcggcgtgacggcttcggcgccgcgggccgcaccgcggcgcaggaccgcggcggcgtcccgcacccacagctggaagagcccgggccgggccggccagccgtcgagccggtccgccaccatcaggtcgaccaccccgaggcgcacctcggcgtggatcagcctcccgtccggcatcccggtccgggccgccaccgtctcgcgcaccccgaaggtcgccacgacgaacgcgacgaacccggccgcgtcgtccacgatcacgaacgggttgagtgccgcgccgccgcccggcgccgccgccaggatctcactgtccataccgccagcctggcagccattgcggtcagtttccggccgcagcatcgagccggacgggccggcggtgtcaggccggggcggcggggagccggcgcttgtgggcggtgaggtggaagcgggtggtgatcgcgtcggcgatctccggcttgacctcggccccttccaggaagtcgtcgatgtcgtcgtaggtgaatccgagtgcgtcctcgtcggccagcccggggcgcagcgtctccagatcggccgtcgggaccttgcgcaccagcgtgtcgggcgcgccgagcgccgccgccagggcacggacccggcgtttggtcaggccggtcagcggcaccaggtcggcggcgccgtcaccgtgtttggtgaagaagccggtgaccgcctccgccgcgtggtcggtgccgacgaccagcccgccgaccgccgacgccaccgcgtactgcgcgatcatccgctcgcgggccttgatgttgccgtgcacgaaatcctgctgggcgtggtcccgggtggtcatcccgccggccagcagggcctgcagggcggcgtcggcggccgggcgcacgtcgacggtcaggacccggtcggggcggatgaaggcgagcgcggtctgggcgtcggcctcgtcgaactgcacaccgtagggcagccgcatcgcgatgaactcggcgtcgtggccggcggcccgggactgctcgacggcgagctggcagagccgccccgcggtggacgagtcgacgcccccgctgatccccagcaccagggcgcgggtgccgctggcggcgagcgcaccggcgaggaacgacacccggcgggtgatctccgcggtggcgtcgaaggtgggggtgacccccagttcgcgagcgatgtcctgactcatgccggcagcctaccgaccggcgcggcgggcgtaggcgcgagcggcgcgcgcccggtccccgcagcgcaccgagcaccactgccgccgcccgctgcgcagcaggtaacgctggcaggggctggagtcgcaggcggtcaaccggtccgcgtccgggccggtcagcaggtcggcggcgtccgcggccaggatccccaacgcgtggtccaccacctggtccgtcgggtgcggcgccgaccggtggagcccccgggcggagctccaccgcagctcctccgcggtcggcacccgggtgatcgccgcgttgatcgcgtcgagggcggcgcggggcggctcgccgccgcgcacggatgcgtccagcagctcccggacggccccgcgcaacgcgcgcagccggcccgcgcacacctcctgcagtcgtgccccggccggcgccagcccgcgcgcgatcagccagtcgcccgcctccgccggcgtggccagcagatcggtgaccaccccgcccggggccacgagccggctgttggccaggtcgagcccgggatgcaggtcggccccgggcgcagtgtcgatcacgtttctcacggtacctcttgcgtctatccgtgacaaactctagcctcacggatatcactactgttatccgtgaggtgcgacatgatcaacgtccagacggccggcggcccgaccgcgctcttcgagtacgccgggctccgcctgctcaccgaccccaccttcgacgagccgaagagctacctctcgccgagcggcacccgactcaccaaactcgccccggccaggatccggcccgccgccctcggccggatcgacgccgtgctgctctcccacgaccagcacgccgacaacctcgacgactccggtcgcgccctgctcgccgacgtcccggtcacgctcaccaccaccgatggcgcccggcggctcggcggcaccgcgcgcggcctcaccccgtgggagtcggtgaccatcggcgacgtcacgatcacggcggtcccggcccggcacggcccggagggctgcgagccggtcaccggcccggtcatcggcttcgtgctgaccgcggaggatcagcccagcgtgtacgtcagcggcgacaacgcggccctggaaatcgtcgagcaggtcgccgaccggctcggcccgatcgacgccgcgatcctgttcgccggcgcggtccgcaccgacctgttcggcggcgccctgctcaccctggacagcgagcaggccgccgaggcggcccgcatcctcgacgcccggcaggtcgtgctggtgcaccacgacagctgggcgcacttcaccgagggtcgcgacgccctggagaaggcgttcaccgccgccggcctgcgcgaccgggtgcagttcggctgaccggccggcatgccggtcagacccccttgacccgccaggcgccgttcagcagcggcagcaggacatggcggtccggggcggcggcggtcgcgcggtgcagctccgcgatcgaccgcgccgactcctccggggtggtgatgccgtgcgcacacgcgaccggcagcaggctgcggtagacgctctccaggatcggcgtgtcctgcccgaccgggagccgccggccggccacgtcggtgccgtccggcgcgccgatcccggccttcgccatcaggtacggcaaccggctgccggcccgcacgtcgcagccggccgcccgaacgcgtccaccaccacccgggtcatcgcgtccaccacgtcgagcggcggcagcacgccgaccgtacccaggtcgtagtcctgcaggagcagacagccgtccggtgcctgcccgggtgtctgcggtccgcgttcggtgccgcgcggtccagctactcgcggtatccatgcaggcggcgttcctcggcgcgccgggcctggcgggcgatgtctcgtgcgctacgcggtgctcggtcgcgccgacgttcgtggctgcggacaggccatggagtcggtgcggtcagtcggtcaggctcgtggctcatggatcacttccctgagtgcggggtgcggagggatcgatgtcgtggtcagtgccgccaccccgggacccgacgtcgaaggcccgggtttccggtggtgggcgtgtggaaccgtcgtgcgggaggcggagcagcgcgtggacgggacggtccggccgcccgggccgtgccgccggtggggtgaggtggtggcggcccgggctgacctgccgggggtaccggcgctgccgtggttgccggccaggaaccggcccgagccgtcaggtggtgatgacgtcggcgatgaggcaggcgatgttgtccggggcgcccgccgcgtgggcgaggtcgatgaggcggtcgacggccggttcaggggtggcggtttcggtcagtgtggtgtgcaggtcgtcgtggccgatgacggcggacaggccgtcggagcagagcaggtagcggtcgccggcctggacggtgcgcagggcgaggtcggcttcgaccggctgggggccgccgccgagcgcccgggtgagcagcgcgcgttgcgggtgggtggcggcctgggcggggctgagtctgccggccgcgacctggctctgcacccaggtgtggtcctgggtgagctgcgtgagttcaccgccgcgcagcaggtaggccctggtgtcaccgatgtgcacgagggcgagtcgggggccggcgaacagcaacgcggtcagggtggtggcgggccggtcgtcggcggtgccggtggcgcggatcgcgcggtcgacgccgtccacggttgcggccagcagcgcgagcagttcggcggcgggccggccggccgggtcgaggctcttcagcgcgtcgacggcggcggcactggcggcggcgccggagccgcgggtgccgtcggcgacggcgagcagccggtcgtcggcgtgggcgacgtcctcgttggtgtcccggacgtggccctggtcgcagcgtacggcgtagcggatggccggcgtggaatgggtgttcggcatggtgacgccctcctgggacaggtgctggacgaggcgggcgacgtggtgcgcgcgggccgcggtgtccgcggtgacctgtcgccagtaggcggtgaccgcgtcggccgccgccccgggttccaggtcggacaccgtccggatgccggccaggggcatcccgatgcggcgcagccgggcgatcagccgggcccggtccagctggtccgggtggtagaaccggtagccggattcgggatcgaccgccctgggtggcagcaggccgacctcgtcgtacagccgcagggccttgggtgtcagccgcgccgcccgggcgaacgcgccgatcgtcagcagctccacggtgtcatcctcctcgtgccggcccggtggccggcacggaccacggtgggccttgccccaggggcaaggtcaacagccacgacgccgcggggtgaccggaagtctcccgcggaaccgaccgatcatgccgaatccgacgcgcctccgacggctgcgacataatccggcgatgcgggaaagatcgaagtggatcgtcgtcggtgcggtgttggtggtcctgggtggcgcggcggccggcacctggcgataccggcagcacgtccagcgtcagccggactggcagatccaccacacggcggtgcccgacgcggcgaagaaggtcgacgacgtgctcgccgggttcgaccgcgaccacctctaccaggccgccgactacctgcactcggccggccggcaccccggcgtgcaggtcctgtcggtcaccgggcagacccactggcagaccggtgtcaccctgaccctgcgggtcaccggccacggcgtggcccgcggcttcgaccaggtcatcctccagcagcgcgacgtgccgatctgcttccgcctgacgatgggcccgaaggacgacagccgggacgacgacatcgactgcccgaccggaccgccgctggcagtgccgcgggacccgaccctggacggcgtcgacccgcgcctgcaggcggcgctgaacccggtcggcccggacgagcccgccgtccgggccgcggtcgccggcctgaaactggacccgggcatccggcaggacttcgccgcccacgacggcgtcgtgggggtggcgctgcgcgccggccggtacgactgcgtcgtcgcccgggtggtcgcccggggcgacgtcaccctctggcgaccgtcgcccacgcagctggcgccgggggagctggactgctcggccgggctcgccatgaccagcgggttcaacacctccccgcactgagtgacccgccgccggcgcggccggacggtgggtgccggctaccgccggccggtatcggcgctgttgaggtggaacgcgcgttcctccgccacctggtgagcgcggaggaaccggtcggtccagtcgggttccgcggccgcgatgcgctccacgacgtactcgtcgagtatccgcccgtcgagagccaccaggctgacggtgaccaccgtggtgccgtcccggccgaagtggcgcggccgccaccgggcggcgcggaccgcccggcgacgggccgcgcgcccgatcgcggccaccagtgcgaacgtgagaccggccaccagcacggcgacggccagagccagtagcagcgcgaagcctcgcacggcggccggctacttcagcggtaccgcggcgcccgcgccgggcgcataggtcgtgacgcccggcggcagcgccttgatgatgtcgatctgggcgcacgccgaacacgcgttgtagccgagttggcgggtcttgttggcgtcggcgtcggccttcgcctgagcgaccctcgcctgagcctcgctcaccgcggcgtacgcggcctgcgccttgttgaccgcgtcctgcacggcggccggcagggtcacccgggccaggttgaacttgatgtcctcgaagaaggcgccgcccagcatgtccgccagatccttcgccaggctgctgttgaccgcgtcctgcaccttggcgatgttcgagttgttgttctgccccgtggcggccgccggcggcgtcccgacgttcgcggtgccctgagcgccgttctgcaccagcgcgcaactggagaccagttcggcgcatcggaagccgctgatctggatccgcaggtcgttgtcgatcaccggccgcacgatggcgtcgaggaagctgctccagccctcgtcaccgtcgtacgcgtaccgcagggtgccgtcggtgccgcggaactgccgggtgccgaacttgttgtcgaaggtggtcatcgtcgtcgggtccaggttcagggtgaaatagacggtgccctcgatgcccatgtccacgccgtcgccggacggggtgttcaccacgtcgaccccggtgcggtcgccgcgccgggcgtccgaggtgatcgtgtagaagcgctgctgagccgggtacttgtgggtggtcgagtacaacccggtccaggtcagacccgaagcgggctggatgacctgacgtacccggttgttgtcgaaccagccgccgttgcggacgaccccgacctcgcccccggtggtcttgtcgaatccgccgaaggcggccgtgagagccaccaccagcaccaccattccgaccactccggcgctgacgagcggcgcgatgcgcctcgccggctggccgtgtccccgctgtgttgccatggcttcgctcccgagatcccgacggtcgaaccggctgtcaggatccaggctcgcacgcctggtccacccgcctccgctgccctccggccggccgcccgtgagcggctgaagcggggttcgaagacagcttctcgattcgttcgacctcccggctgagatgcagagccgctgcggttcaggccggtacgtgcaacgcggatcgtggctacgtcggcttttcgaacgtcagtcccagaagttgaacaccgtttcgcccacacttgccggtcgccacgaagcaatccggctcccggacggtccggcaccttggtggagcggaaacccgtcgctcctcgttccagccgaaacaccacatcattctgttcgcgcccgatgcgacgatacgacggcccgaaaggaccggctcgacgcctctcctcggcagcagtacgaatgtgaacaccagctcgtggacacggttaatggccacggcgctggtcgacgcgcgcagtctgcggcaggaggatgcaccgagcgacccatcatgcttacgtttcagctgccacatttggaccactattcgtctatctcgtggcggtatatctccgtggatctcgtacatctcgcaataggatgacggcgtggcgacatgggatgtgctgacggaccctgagcggatttcgtgggaagggtcgccgctcaggtcagtcgggcccttggtgttcggcatgacccccgaagagactgaatcagcagttcgagggaaacttcggcgcaccgccacgatgcacgcggcagacgtggggatcggcgccatgcatttctgcctcgacgtgtccggcggcgcgcgtttccccggcagcgcggtcgccgcatatttcagcagtacggccgggctgagcggggtcgccgtcgatgcacgatggggaccccaggtggcgctggcgggaatcccactcgtaggtcgaaccccgtcactattggcggctcaattcattggctacctgacaacgctcgaccatcagatacgctattccggtgagggtgaaccatgctcaccggacctcggagtgggcctgcgggtgcaacgagccggtgatgtggtgatcagtcgaccgatcatggtggcagaggtctggaccgatcggtgctgggacggccacgaaggccaccttccgaaagaggagtggtgcaccttttagaggcatgccgcgaggcactcttctcggaggcgttgtggtgcgtcgagaagccgggtcaagacgcccgtcgggttgtcagtggcgccggggcaccaccgccgccacggtgccatgtgccgaccggcgagctcagcgcctcgcggtgacggtgatggcgccactggcgaggatgtggctgctcatggtgaacatggcgaccgccggcggcgtggtggcgggcagggacagggtggggacgtccaacgcgtacaccgtcaggcggtagtggtgcgggatgtcgccggtgggcgggcacggacccaggtatccggtcctgccggcgtcgttggtgccggtgaccgcggcggaggggagcgtgctgccggcggtgtcggtggtggccggcagatcccatgccagccagtgccagaagccgctgccggtcggggcgtccgggtcgtacatggtgacggcgaagctgcgggtcgcggccggggcggcggaccaggtgaggcgcggctgcacgttgtcgccggcgcagccgaaggcgtcggccaggtaggcaggcgggaagctgccgtggacgtcggggctggcgaccgggaagtggccggcccggtgcggaacggcgtcgcggacctggtggtagccgtaggcgccggtggccacggcgatggtgcaggctgccgctgcgatgtgtcggatcatgccgatgacgatctctggtgcgggcggcggcagggaggccgccgcgagcctggtatccacagtgccaggattcggcatcgacacccggcgggcggctcgccatgatggggcggtgacgggtgagcggcgggtcgagctggccggtttcctgcgcgcccggcggggcgggctgaccccggccgacgtgggcctgccggccgggccgcgcaggcgcacgccggggctgcgccggcaggaggtggctcagctggccgcggtcagtgtggagtggtacacgcggctggagcagggccgggtcgggatgcccggcgcggcggtgctcgatgcgctggccggtgcgttgcggctcggcgaggcacagcgacgacacctgcacctgatcgcccgcggcgaggcgccggtgcagcggcacgaggcggctccggtcagtcgctcactgcgggtggtgctcgacgggatgccgctgctacccgcgtacatcatcgatttccgttttgatgttctggcctgtaacgccgcggcgagggcactgttcggcgaccggttcggggcggagaacgtggcgcgccaggtcttcctcgacgccgggctgcgcacgtcgcagctggactgggcgcagatcgcccgggagatggtcggcaacctgcgggccaaccaggcgcggcacccgcgggatgcccggctgcgcgaggtgatcgacggcctgcggcgggagagcgccgagttcgccggctggtggggtgatcagacggtggtcgagcgatcacacgggcgcaaacggatccggcatccggtcgccggggtgatcacggtcgactacgacgcgctggcgacccgggacggcagcggccattcgctgttcacggtgaccccggccggcccggccgacgagcgggcactgcgcctggtgatcgggcagcacagccgggcgttgctggcgtgacctcggcgtatgtgtgctttgcgctgatctcggcgagcgtgccggcggcccggatgaccgcgcggctgggtgtcgagccggatgaggtgcgggtgcggggcagtgagcagaccgcgccgatggtggtgccggtcgcgcacagctgggaggtgcactgccgcaagcccgatctgaccgtggacgagcagatcgggctgatcgtcgaccggctgtccgatcatgccgcccggatcggtgacctcgcggccgagctggctgagcgggacggtgacgagggcgggagcctgctgcaggtggtgcggtgcgtgaccggcggtgatccgctcggctggcatctggatgcgcggctgctggagttccttcgtctcacccgggccgagttggacgtcgacgagtcataaccaggcttcactactgggagtgaccgaatgaacgggttatcactatgcagtggcctggtttacgaggacagatcggacgttcggtatgtcacagtccgctaccccggacagcgtgacggctactcgcggccggtagcctcccgcaccatgcgtggatccaccatcgcagctgtcgccacgttcacccttctggcgatcaccggctgcgcgaacagtgacaacacccccaccaccgccaccgcggccggggcggcgaacaccgcgggcctggacaagggctccgcgggcgcgtgcacggtggccgatcaggccacccgcggcgagaacgggcgcgacctcgacctggccaccgccaaggacatcgtcgccttcggccgcacgtcgcgcagcaccatcgtgaccgcggccaccgacgtgctcagcgccgcgctcgacaaggcgcaggccgctgccggtgagccggacgagctggtgctcaaggccgaggtgggcaacgcgatcctcaaggtgcagacggtctgcaaggaccccgacgcggtcaaggcgagcatcaccacgcccagcaccggcggcgcgggcggctccaacgagccgaccaggtcggtcaaggacggccagatcaaataggttcgcggtagccgcttcgggccgggacgcttcgacgctcccggcctctttcctttctcgggagctaccccgcctccgggtgccagggacgggtggcgtcggtggacgtggcgtgggcggcgacctcgacggcgtaggtggggcggtcgccggggaccgggccgaggtaggggtgaccggtcaggtgacaccaggccggcaggtcgagcggggcggccgggtcggtggcgatcaggtgcacgacggcgcccgccggcagggtcgcgatcagccgccgcaactcgatcaacaacagcacgcagcggcggtcgccgccgtcgagcacgaccggggtcacctcagtctccacgggaaccatcctccccctcccggacggtgatccgcgggcggccccgccgccggccgggcgggagctccggtggtcgtggccggcggctggacgggtccgcgtcgagcaggccggcgacgaccggaccgctcgggccgccgggggcaccgccgcccagccgacgcggaccgagctggacggcctttatgccgccgctactcccgatcggcttcactgaccgcgtggacaaccagcaatccggcacccggatcaccagcatggacagcgaagtcggccggagcggacgcgtccgcgtcgcggtcctcgccggcgcggcgatcctggccctggccggcgccctctacgtgctgcgccgcccgctgatgatggtcgtcccggcatgcaccggcggccagtggaccatctgcctcaccacggtgaacggcgacctgctgctcaccgtggccgccctgccggtggccctgctgctggtcgccgcgctcgcccaccgccgccggctcgccggcactccggccgcctggcggctgtcgctggccgaggtcggcctcgtctactggaccgtgccgtgggtgtggctcaccctgcagcccggcccgggtgccggcgtcgtccccggccgggtcagcctggtgccgctgcgtgacctgctcacgatggacaccggtcagatcgtcggcaacctgctgatcctggccggcctgggcttcttcgccccgatccggttccgggcgctggcctcggcgccgcggatgctggcgctgggcgcggcctgctcggcgctgatcgagaccgcccagtacgcgttccagctggaccgggtctcgtcgatcgacgacgtgctgctcaacgcgaccggcgccgccctggccgcgctggcgtcccggcgctggtggcgcgcctgagcgggcggccggtcagaccaccaccacctcggtcccggcccggcggatcatcgtggcgttggtgttcgcctcgatctcgtcgtgcgtggtcagcccgccgcgggcgctgatcccgtcgacgccgaccaccgcgaccgccatgaaccgctcgcccagctgctgccggcacagcggttcgccgtcgccctggccgcccaccgcggcctcgatccggacccttcccggctgctcaccggtccgtggtccgcacctgagggggagctggcaggtcggccgccacggtggttccgtcgactcgggcgtgtccgccggctgtcccgggagcgggatcgggcatagggtcatgatccatgacgagccgcatcggggacatcatcgtcgactgccgggatcctgagctgctcgccggtttctggtgcggcgtgctgggctaccggatcttcgcccgcgatgcgaccggcgtggcgatccgcggggcgacgagcagcccggacatcctgttcctccacgtcggcgaccggaaggcgacgaagaaccgcctgcacttcgacgtctgtcccacggaccgcggtcaggacgaggaactcacccggttgctcgcgctcggcgcccggcggtcgagcatcatcggcagcggctcctgggtggtcctggaagatccggaaggcaacgagttctgcctgatggccaaacggatcgccgccgagcctgctcccttccacgacgcctagccgacgctcgacctcggacacccggtggggccgggccggcatcctcccggcgatggtgcccgtcgcgattccggccgccccgctgcggggagtgtcgaccgggctcaggccacggtcgcgaccatcgcggtgaccttgcggaaagtttccggcagcgaggtctccggatgctccatccagtactgcacgctggaccggaacgccgtcatgaactgggcgaccaggacccgggcgcgcaggtcggcgtccggcccggtcacccggtcggcgatcagggcggcgagctccttctcgatcgccgtgtacgcggcgatctggtgggccaggtggtgcgggtcccggtgcagttcgcggcgctgtttcagccacaggtcggaggggtccgtggcggcctcggtcatcagctccagggcggcgccggtcagcacggtccacgggtcgccggtgggctgggcgctgatcgaggcgcacagccggcgcatccggtgggcctcgcggtagtagaagacctcctccttgttcgcgaagtagttcgtgaacgttcgccgggagacccctgccgattccgcgatggcgtcgatggtgacgttgtccgcgccgcgctcggcggccagccggacggcggcttcgtgcagcgccatccgggtggccatcttcttgcgttcgcgcagcccgaggttctcgtccaccccgcaactttaatgcggatctctcacttcgcgaacggcaaatttgcctaaagtgcagcgcccgagggcggctggatgagcgtgtcgcgtttccggaacggcgtccctgtcgcggtcgcggcggtcgccgtgtggctcaccgtccgcggccggcttccggatccggcctcgatcgggacgatgctgcgtacgtcggatggccgccgggccgtggccgcccagggtctttcgccatgcgcgttcgccccgcggcggcgccgcctgctcggtcccgccggagtgtcgatcacgcggggcgtggcgaccgcggtgaccgtggcccggtcggcgatcagtccggccctgccggccggggccgcgatgccgggctggtggagcccgcggcccaccccggcagcggagacgagacgcccgacccggtctgatcggcggcgtctgaccggggccggcgtcgggccggcgtgaccggacgtggatgctccggccggcgggaggcggcggccagccggtcggccagctcggcgaccaggatgcgcagctccggcggctgctcgatgatgaacgggcggtccacggcggccagcagcgccgggacccagtcgaggcgctcggcgtgcaggtcgacccgtacccagtcggcgccgtcgtcgtggatcaccgcgaggccggccggcaaccgggagcgcagatggtccgcggtggcctggacgcgcacgcggaccgcgtgccggtaagcggccgtggcgaagccggccagcaaccgcgcggccgggtcgaaatcggagggtggcgggaaggtgccgggcagcgggcgggccgcctcgacccgatccagccggaaggtgcgctccgcgccgatctccgggtcgaggccgctgacataccagcggtcatggtgccggaccaggccgtacgggtgcagcgtgcgctcccggccgccgtaggtgatccggatcggctggtggtcgcgcagcgccgccgacacggtcagcaggatggtgccgtccggggcggccgcggccggcgtggtgacggtcagtgactcgcggaccgcgtcgagcttgcgctgcagtggcgcgggcagcacccggcgcagcttggcggccgcggtggcgctgctcgtcgagtcgccggacaggcccagcagcacggcgagtgcctcttcctcggtgaacatcagcggcggcagccggtgcccgcgggccagccggtagccgccatgccgcccgcgcaccgactcgaccgggatgtccaggtcgaccaggtgctggacgtagcgccggacggtgcgcgcgtcgacgcccaggcgctcggacaggtcggcgagggtgcgcaggccgccggactgcagcagctccagcagggtcagcacgcgggcggtgggcctggtcacgcccttgacaatagtgggcggaagctgtccagtatcggccctagcctgctcggcatgaacctcgtttcgcaacgcgtgatcaccgccgacgtcgcccggctcatcgacttctacgagaaggtcaccggcctgcccgcgcaccggatcaccgcggacttcgccgagatcgtcaccggcagcggcaccctcgcgatcgccggcgccgcgaccgtgccaccgtccatccgggcgggggagcggatcaccgaattcctggtcgacgacgtcgacgccgtccccgccgccggcgaggtgctgctggcgccgaccaccatgccgtggggcaaccggtccaccctgctgcgcgacccgagcggcggcctggtcaacctgttcaccccggtgaccccggccgcgatcgagaagttcgcccggttccgcggctgacatgtggcgggtcccggcggaatggccatccaccgggaccctctttaccactgaattgcacacaccagcacgtttaagagcgggatcagtctgaagacaacgtgttttgcctttaaactaccgccgttcgaagcacggcggactggagttgaaccagcatccgcagtcgtggtcccggccccctcgatctggtgatcagtggtgaatgctgaccttggagcgagaatctgagtgtgataccggctgcctctgccaggcttgggctacccccgcgcgcctggtgcggggggcaggatttgaacctgcactgtgaccggtggtgtcagcttcaacttcaggtgtcagcttcacgccgtcgccggcgcatccccgcgctcccacggggagtctgtgtgttacccgaacaggtatccgaacacggccgcgccgacccgctggtcgacggcctcggtgttgttcgcctcctcgcgggcgaacttgaccgcggtctgcagggccaggacccggtcgaggatctcgttgacccgcttcgccggcagcgccccggagaacttcaccgtcgtccagtagccgacggtcacatcctcgtagtacacctcgacctgggccgggtgcttgtcggtggcctccgccttgacgtggttgcgcggcaccttcttggtccggttggtccgcaccggctcggtccgccagctgtccgtggagtcgtcgcgcagccacgactcggcggcgtccagcaccggcagcttcttgacgaacgtgtgcaggtcgaccagctgcttctcgaggaacagcagataggtcaccgggacctgggcggcgatcgtccggccgtcgacgaccacgtcggcgcgggccacgccgttcgtccagtccttggtggcggtcacgtcgaagagccgggtcagcgtggcgccgacgtcgcgcaggatctcctcggccttgatctgcacccgggtcgactcggcgggcagctgctcgccctcctcgtccttcggctgataggtgcgcgagatgccggccagcggcccggtcttctgcacggcgtggtgcgcgtcgctgagatcggcgaaagccttgctcttgacgcccttctccaccgcgatgatctgattcagcttcggcactggactcccccttaagcgccggaaccctaacatccaccggccaccgcgaacgatccattaaccgcctgtagtctctcggccatgcgacgaggacggcttctcacctggatcggtccggcggtcgtcatcgtgatcgtcgctgtctatgccggtggcatgctgctcggccgctggcgcagcccggccgatgcgcacgcggccggcagccgccaggcgtgtccggagtcgaccgacccggggcaccgcaaagcggagaccgagctgtgcccgctgatcaaccggcccgagatcctcaccctcgtcgacgcgtcggggacggtcaaaggcatcagcacgtcgtacgacccgcacggcgagtggtacgagtgcacggtgacactgccgagcggctcgctgcgcctgaacgtctggaagggtcgcacccggctcgcggactaccggaaactgatcccggaggcgcagccccgcaccgtgctcggccgccccgccgcctggtggcccgactccgcggccatccaggccatcccggtgaaggagtcgtcggtgctggtggcctgggaccgcgccgacaccggcgggatggtggagatctccaccatccggaccgagctcgatcccgccgaccaggccccgctcacccggatcgccgagcgtcaactccccggcctgccgggctggccggcctgaccggcatcgcggcccggatcgtcgcctccatccgcggccacggcaggcccggcggcagcaccaccaccgtcacgtcggagatctcgtcccagcgggccaggtccgcggccacggtctcggccgtgccgtaggaggtgaactcgtcgagcagcggctgcgcctgcgccgggacgacccgggtggcgcggaccgcggcgacctcggcggccagaccctgcccggcgaccaggcggggatagatgtcgcccatcgcgcccagatacagcgcggtgcaggccgcggcggcggcgcgggcggcgtccacatcggggtcgacgacggcgaacggcccggccgtgacggtcaccgggcggctcgcggtgatcgccgggcgcagctcgcggatccggtcccggcgcagatacagcgggaaccagccgtcggccagctcggcggtggcgcgcagggtccgctcgccggtcgccgccagccagatcggcagatccggcacgggcggctggcccaaccgcagcggccgggcgccgcaagtcacggcccgctcgccccggagcagatcccggacccgcgtcgtgacctcgcgcagccgcgcggccggatgcgtgtagggcaggtcgtgccagccctcgaccagctgcgggctgctcgcgccgaggccgagcacgaaccggccgccggacagctggtgcagcgtggcggcggccatggccagcgtggccggggtccggttccagaccgacaggaccccggcgaccagggtgatccggcgggtgacggtggccagctcggccagcaccgcgaccgcgtcgagaccccagccctcggccaccgagaacagctcgaagcccaactcgtcggcgagcgtcgcggcccgcacgatgacgtcccggcgcgtctccatcggggtgatcccgagaccgcgccgcatcggtggatcggtgttcgacatgcctcgacgctaggtgcgcggccggctgggcgaagcggtgtttctacctaagcccggcagccgggcggcggtgccgaacggggccggcggcggtcaggcggtgaggtcggccgggatcagcgaatagatcgccaggtccaccctggccccgtggaccatgccggcgttgcgggcgacgccctcgaaggtgaaaccggccttctcggcgacccggacggaggccgcgttggcgggcgcgatccgcaggaccacccgctcgaaggcggccccggtcaacacccagcgggacagcgcggccgtcgcctcggtgatgacaccctggccgcgggccgcgggtgtcgcccagtagccgatctccgtcgcccggtgccgccagtcggtcttcttcagatcgatgacgccggccaggacgccgtcgcattcgaccgcgcgcaccaggcccgcgccgctcgcccgcgccgccggcacggtctcggccacgaaggtgaccgcgtggccgcgttcgtacggaaacggaagcggcagccagcgctgcgtttcctgatccgaggcggcggccgcgatcgcgtcgacatcaccctcgtgcggcgggcgcaacgtcaggcgggccgtctgcaggatggcatcggggaacacgtttccgctcacccgtcgatcttcacccatgcagacaagccggcggccgacgcgctgatccggctctgccacgacgaggacgacgaaacccgctactacaccctgtacgcggccacccgcgagcttacgggcctggacgttcaggcggtcaccgacctgacggcacagcttgccgacgatcccgacgagcaggtccgcgcgatggctgtcgaccaccacgaagccatccatgaaattcgcaggctactcaccgacgccttcgggtccggcgataccgtcggctgccacgaccatctgatcggacccgtcctggtcaccctcgccggggccggcgctgccgacgacgcccggctgtggctcgatgccgagatccgccggcatctcggcgagaccgcgggacggctcgacaccgcagacgtcgcgggccggcttgtcacctggtgggccgaccgggagagccgcaggtggggctgaacgggcgtcacagccggtcggcggcgtccagaaccggtgcgcggagaagttccgtggcgccgatgacctccaggcccagcacgcgtccgtcggcatcgaagtcgagaacgatgtcgccccggccggggcgctccacgacgacgttctcgacggcggcgccgtcggcgatctcatcgacctcgaggtaggcggcgttcgcttcgctgtcgtacgtcacgcgcatgcggacctaccgatctcgtggtgggtggacggtcgcggggtccagcggttccgcggcgggtggcggtggcgcgtacgccgcgatcatggggtggaggaaggccgtcaggcgggccgggatcgtctccggggcgttgcggtccggggcgttgtggtcgaggccgggcaggatctcgtagccggcgcccgggatgagccgggccagcggtggcaggatgtcgcgcaggtagggcggagtgcggctgccggccggcagcgcggccagccggtcgtagtggtgggcgcggcggttgctgccggggacgaccagcccggggccggtaccgacggtccggaaggtgatcacggtgccgtcgtccgagatgccggaatccatggtggggagcgtgacccgcgcctctggcataccgctggtatcaccctgacgcggccgatccgtgataggcctgatcatgagatccccgacctgaggagtgttgcagcatgctcgctggccgtctgaacgtgtcgaccgggacgttcgccgtggaggaggtggacgagccgcacgccggacccgggcaggtgcggatcgcggtgcgggccgccggggtgtgcctgtccgacgtgcacctcatccagggcatgctcaagccgctgcacctgcgcggggacagcgtcacgctggggcacgagacggccggggtgatcgacgaggtgggcgcgggcgtcaccgggctgaccgtgggggagcgggtgctgctgcaggccggcgagtacgccccggacggcagcgtgctcacccgcggcgtcgactacgacggcggctgggcgcagtacgcggtcgccacggccggcaccgtcgtgccgattccggacaccctgtcgtacgagcaggcctgcttcatccccgacgcggtgtcgacaccgtgggcggcgatcaccgccaccgccgcggtccagccggcccgatcggtcggcgtgtggggggtcggcgggctcggcgcgcacgcggtgcagctgctgcgggcgatcggggcggcgccgatcgtcgcggtcgacccgctcgaagcggcccgggagcgggccgtgcagttcggcgccgacctggccctggacccgaacgatccggcgttcgcggccgcgatgggcaccgcgaccggcggggcgggcctggcgtacgcattcgacttcgccggcgtcgccccggtacgcgtgcaggccgcccggtccctcaccaagggcggcaaactgaccctggtcgggctgaccgaccagccgctgaccattccggacggcacccggttcagctacctctcgcaggagatccgggggcactacgggtccgggccggaacacgtgctggagttgttgtcgctggtcgcgctcggccggctggaattctcccggtcggtgagcggtaccgtgccgctggccgacgcggccgaggccgtccggcgcctcgaccagaaggaggacaatccgatccggttgatcctcgtgccctgagcgggaatacgcgaccatggatcggtgagcaaaacccggtcgatcggctgctacggggcaccgccgccggatcatcccgaccccaggcgggagatctgggcgtacgacggtgccctcgccatcctgctcgcccagctgctccgcgacgtcgaggggatcccgcccgaccaccgtccgccgtggtgggattcccgcgtcgaggagctgcgcacgcaggccatgttcagtgacctgttcttcgacgtggccctgggcctcgaacccgggcagcgcgaggagctggccgagctgttcgaggacagcgcggaccggctggccgagcgccagccccgcaccccgggccaggtcgacgactggcacctggtgttccgcggcgaccacgcctacgacgtggggccgatcgccgagctcggacgcgcgctcggcgagctgctgcgcgggacgctgccggcgccgccgcccggcaccctctggttgtacgggacgccgggcgggcggaccacgatcagcccgcgctgaccaccgtgacccgggcgccgtccacggtgggacgctcgatctcgtcgagcacggcgatggcgagatcggcgtacgacagtcggccttcgctgatcgtctcaccgcccagccggtaaccgcccaggcggggcagttccgccgacagcagcgccggcggggtcagcatgacccagccgcggtccgcctcgcgcagccgccgcaggccggcggcgtgcgcgtcggcgaacgcccggaactgctcgggcagcggatcggcaccgtccaggttgctgaccagtccgatcgcgacgacccgggggacgccggaatcgaggagcgcgccggcggccgtggcgaagaagtccggatccaggtcgagtgtcgccaactcctccgggccggacgcggggctcaccgcgttcaccgcggagtcgtgcccacggacgatcgcggcgacgcccgcggcgtccgtgacgtcaccggtcacggcgggaaggtcgggatggcgggcggggtcacggacgacggcggtcacggccaccccgcggcgccgggcctcggcggtgacggcgcggccggcgcggccacccgctccgaagactacgatgctggtcatgtcgggcacggtaggcggcgcacccccggttaccgcaacgaaaccggcggtacgctcggggtcatgacggccagcctcagcccggacatgttcgacccggcctgcccgacgaccgcgatgccgctgcagatcggtgacaagtggacggccatggtcgtgctgtgcctggagcacggcccgcgccgcttcaccgagctccgtgtcccgctgcgccgcgtcaccccgaaggtcctcgccgaaaccctgcgcgcgatggaacgcgacggcctgctcaaccgtaccgcctacgacgagaacccgccccgggtggagtacgcgctgaccccgctcggccgcagcctgctcaccctggtcgacgccgcccgcgcctggtgcaccgaccacttcgacgacctgctcgccgcccgcacggcctccgcggccggtgcctgaccgccaacgccgccgaagttcgaccgccaacgccgccggtgcctgaccggctcgccctccgccgtcggtgtctggcgggctcgccctccgccgtcggtgcctgaccgcggcactcgcccgccgccgaggccccgccgcgatggcccatcagacgccaggcgatcccccggcggtcagggccggagcttgccgggcaccggtctgccgtccaccagggcgatcgtcaccatccgctgagggcggccggtggtgtcggtgccctcgtcgaagacgaccaggtgcaggctggtcgctggtccctggtccctggtccctggggcatggcggcgcggccgatggtgacgacgcggtcgccgcccggcgggtccgttgcgggtggtctcgtcgaaggcggcggaatccgcgcggccggtcggctcatgccgctcctacgccggagagggcgcttgcgcttaccgatcgagtcgcagcagggtctcctcgatctcggcgccgcgcgcgttcgcgtagcccctcgcgctgccgacgatgtggaagccggcgcgttgcaggacccggagggaggcggcgttgtcgccggccacgctggcgtgcagcgggcgggtggggaccaggtcgaggagctgggcgagcgcacggccggcgacgccctgcccccagaccgcacggtcgatccagtaggtgatctcggtgtcgccctccatcgggaagctggagatgctgccgaccaggcggccgtcgagggtgaccgcgcgcagggtgacgcccggggcggtgcggattctcgccatgtgcgcgtcgaacgcggcccggtcgtccggatccttcgccgtgaaggcggccatccgcaccgcctccgggtcgcgcatcatcgtgaacagcgcgtccaggtcggcgtccgcgagcggccgcagtgccacgacacccatgtgaagcctcctccgattgccgggtagggcgcgaacctaccaaccacccccgacacttttccgctcggcgacgaccgcggcggaccggtccgcacggccgcgacgactccgacgggagcatccggcgggtggcgatgccggtcagaatgagcagggcggccgcggcgcagaaggcgtcgcgtacgccgtagccggcagttgactgtcgcaggtagatcgtgccgagcacagcggtgcccagggtggcgcccagctgctggaccgtgtggagcaggccggtcgccgaacccgtctcggccgggccgacccggtgcagcgcggtcgtgaagaacggcaccgcgaaaccgcccggcccggcgccgagggcggcggtcgcgccctgcgccacgcgggcggcgatcagcaggccggcccagggggccacggcgcacgccacaatccatcatcgcggcccggcggcgagcctccagccggggcagagcgatgacccgcagcgcgacccggcggcgagcctccagccggggcagagcgacgacccgcagcgcgacccggcgcgcagccgctgaatagcgccgggcgaccgtctgcggcaacacgcccggcaccgcgccgacccggcgcaacgccacccggccgtcccgatgcggcgcgtgcaccggaccgcggtcgacgtcatccagcacgacggcgcccccccgttcagcgacccaggacagcgccgccgttgaggccgatgatctggccggtcaggtagccggcctcggcggaggccagatagccgatcgccgcggcgacgtcggccggggtgcccgggcggccgaccagggtgtcggcgatcttggcggtgacgaagtcgggggtgtcccggccgtggaagatgccggtgtcctcgatgtagccgggtgccagcacgttgaccgtgatgccgtccggaccgagctgccgggccaggccgagcgcccacccgtgcagggcggccttggcggcggcgtacgacccggcggagtgcgggccggaaccgccgcgctgggcggcggccgagctgatcatgatgagccggccgccgggccgggccagccgctccagcagcgcggaggtgagcagaaccgcggtgatcaggttgacgtccaggtcgtggcgccaggcggcggccagcgcgccgaggccgtcgccggccggcggggtgatgatcgcgccggcgttgttgaccaggacgtcgaccgggcccagccggccgatctcgcccgcgacgcgctcgacctgatcgggatcggtcaggtcggcgctgatcggcagcacggcgccgctgtctcccgcggcggccgggcgccgtaccgcgccgccgttctctgcggcggccggaagccgcagcgttccgctgtcttcggtggcggccgggcgccgcacctcggcgttgatggcggcggcggtccggtgcagcacctcggcgcgccgcccgatgatcaccacccggtcgccctgcgcggcgaggcgtcgggcgacggcccggccgatgccggtgccgccgccggagacgaccgccagccgggcgggactcgatggatccacgcccgtcaggataggtgctgggtgaggaacagggcggcccggtcgagcgccacgtccgcttccggcaggtgcccggcgaaggcctggaaaacgtgcggcaccccggcgaccggcggcgcgccgccgacggggtctcattggggcagttcgagttgctgcgctacctgcgcgaacacccccggtcccgggtggccgacctggccggctggttcgccatcggggtcggcgcgaccagcaagggggtcgaccggttggaggcgcgcggctggatccggcgtctgcccaacccggcggaccgtcgctcgtcgttgccggagctgaccgaggccggcgccggggcgctcaccgcggcggagcggaccttcgaggccgaggccgcgcaactgctcggcctggtgctcacccggcggctctggccgcggcggccgctgccgtcggcgtactccgcaaggctcttggggagcgaaatctgggtgccccggtgggctgaccgcgagctcgcgcttgtcgctgacctgcggcgtcaggccggcgcgctcagcaacccccggttgtagccggccgccaccgccgccgcccggtccttcacgttgagcttggcgtagatgttgagcaggtgcgtcttcaccgtcgcctcggtgatgaacagccgtgccgccgcctcccggttggtgttgccgtccgctatcagccgcagcacctccagctcgcgcgggctgagcggcccggtcgtcggcgccggcgtccgcacccggctcatcagccgcgccgccaccgacgcggagagcgccacctcaccccgggccgccgcccgcaccgcccgcagcagctcctcgcggggcgcgtccttcagcagatatccggtcgcgcccgcctcgatcgccggcagcacgtgcgcgtcggtgtcgtaggtggtcagcaccagcacgcgggccggcaccccgcgccgggacagctcggtgatcgcggtgaccccgtccatcccggccatccgcagatccatcaggatcacgtccggcccgaccgcctcggcgatccggaccgcctccgcgccgtcggccgcctcaccgaccacggcgaactccgggtcgcggtcgaacatggcggtcagcccgtcccggacgaccgggtggtcgtcgacgaccagcagcttgatcgggtcactcacgggtggacctccgcggtcgtcaggggcaggcaggcggcgatcccgacgccggcgccgggggcggactcgatctgcagtgtgccggacagggcctcgatccgttgtcgcatggcgaccagtccgaaacccccgccccgatggtccggcgcctggtcccggtcgaaaccgggcccgtcatcgcggacatcgagagccacttcgcgatccatgtacgacagggtgagacccacccgggtcgccccgcccgcgtgtctggccacgttggccagcgcctcctgcgcggtgcgcagcagcgccacctccgcctcgggccgcagcaccatcgcctgcccggtcacggtcacccgtgccgggatgccctgccgcgccgaccagcgggccgccacctcggtcaccgcgtcgaccagccgcccggtctccagcggctccggccgcagctcgtgcaccgaccgccgggcctcggccagactctcccgggccagcgcggtcgccgccgcgtgatgccgtcgccacgccgccggatcctgcgcggcgtgctcggccgcctgcagctgggtgatgatcccggtgagcccctgggcgagggtgtcatggatctcccgcgccatccgggcccgctcgtcgagcaccccggccgcccgggcctgctcgacgagccggtcctgcagggcggcgatctcggccaccgcggcctcccgggcccggtggtgttgcgcgctgatctccccgatccaggacaccaggatcatcggcacgatgttggcggccacgacggcgagccaggtcagccagccggtcacggtgccgtactcaacgccggtggcctgcgccgtcccggccaccgtcgcggcgccggccacgaactacagctcctgcggccagccgatgatccggaaggcgtagaagtacagcgccggggtgtagaacccccaccacgggtagcgggccaccatgaccaggccgaagaggatcagcccggcgaggaacacccccatgatcaccggacgccgccgccagccgggccgcagggtgaacagcaccagagtccagaccgcggcccccgcgccgagcaggagatcgacccggacgtcccgacccagcgccacggtcatcgcggccagcaccgccagcagcccgtagggcaccacggtgaccagcggctcgaaccgccgctcccagggtggcgaatcctgcggctccacgctcactccccacggtcggcactcgacacagtctcgcaagccgccgcgcgtcccgggctccctcatcctcccgacccggcggctgaccgcgctccaccgatcggtggagcgatcaagccgctacccgcccccgcaccgcctttccaccagggcgccgatccgcgccgccacctcctgcgtcacgtcggtcagggcgaagccggcggcccgcgaagatggacgtgtgctgcgggaaactgaaccggtcaccgcggtcgtgccgccgaatcgcgcccgccagccgcgccggcgcccgtagggtcgacacggccacggcgagaggagcgacatgccgaccgactggtaccggacgacggagtggcacgagtcggcccaagccgaattcgaacggcgtctcgcgagggcgcgtccgtcgagccgcggccaataccttcggatcaaagccgtcagcctggccgaggccggcatcgtcgacggagcgcgggacctctatcgccgcgtcgtgaaggtcgaccccgacggctcctcggcggcgtcagccaccgagctgctcggcgacctggaacgtgcgcaaggtaacgctgccgtggccgaacagcactaccggacactgctcgaccgttggccgaccctgaacggcacgagccgtctggcggaactttcgcttgccgagctactcaccgaacacggcgacgcgcaccacttggcggaagcggacaggctgctgatcgcgtgcgcggaccgtggcctggcgttcgacgacgccatcttccgctggaacgtcgcacgtgcacgactcgccgaccgactcggcgacgaccagtcccgggcagcggctgcgacgacggcgctggccctggtcgggaaaggaccgcagctacctcgccatcctgatgtcggcctggtccggaccgacgaagccacgctgcgttggctgaagcgactgacgaaccgtcccggcgggtagcccgaccgccacgaccgcggatcgccatcctctgctggaccacctgtcgcgcgtcacccgagcgacgcgcgcgggttcgtcatccacatcactggtttcgggatgatcaggcgtgcccgcgctctctaggctcacgggcatggcatcccctgtcggagcttgttggagctcacctcggcgctcgatcgcggacgcgtcatcgtgcgtctggctgtccctgcacctgttgctctatttcatgctcgacgtcgccacgctcacggctttgagcgcgccggaagtcggtggcgggcttcacttcgcatcgaaagccctctacctcttcggtctggtcctcacttctgttctctggccgctaccgttgcagagcgctgcgctcctgctggccgtgggcgcgttggcgattctgcgatccggtgcgggtctgccgaggccctggttccggattgcggccgtctcggtgttcctgatactccctctgctgctggcccttctgctgtccccgggcgactccgcccccttcctgcaggtgctcccgatgcacatcctgatgggcctgttggtggtgcaaccgcgatggccgaacatggtcccctcccgggaccggcatcgatggtgacctgcgtgccgaagtttcgggggccagcggtctgaaggggggtcaaggacatggttcggccgaggagagtgcgcgtcaagaggccggcgttccggcatgccggcgtgcggcccgcagcgggctttccgcaccgagcgccttcaccaacggatcgggcaacttcacggtgccgtgcccctgggtggagacggtggcatagacgatgccgccgctgcaaacggttcgaccctctcggcggaaggcaaagtccagcgtaaagcttgtggacccgatccgggacgtactgatcaggacctcggtgcgctcgtggcgtcggactcccgcggcgaagtccatatcgacgtgtacgacatgcacgtcgaaacccagaccgtgccattgctggtacggcaagccccggccctcgaagaacacatcgacggcctcgtcgacatgactcaggtaccacatgttgaacatgacgccctggccatcgatctcatggaagcgagggctgaaggagtagaccggtgcgaccgcatcctgtgtcgtcatgacttcctcccgggttcgcaactgtcgccatccgggaccgcaccggctgcgatccgcccgcaccgccgccggacgatgactcctcgtccggcgcctgtcaacagtacggggccgagccttgaaccgggctcccgcctcgtgcgggccgaggtgtgaccatgacggttgccgcccctggcctgcgaccgtcgacgcctgacgacggtaaccgtgcagggccggatccatcggctgccgaacggcgcccggctggtcgtgctcctcgacgaaccggccaccgttgacgggcggatctgtgccggcgttcacgcccggtggctgcgcgcgacgtgaggctcggggtcagggggtgccgctggggcggggcgtagaggggcgacgcgggtggttgccggtccaccgggaggggcggcggcgccgcggtgggacgcagcgctcggggtgcgtgcggtcggcggccgtccgatcggggtgtgcgcggtcggcggccgtgggggtggccagccggcggaggcggagccaggagagccagcccaggccgatgatgaagccgaagctgacgatgcggtagaggacgacggcggccaccgcggcgggggtggcgacgccgccggtgatcaggccgaggatcagcgcgctgtcgatgatgccgaagccgccggggacgatggtgacgccgccggccgccatggcggcgcagaaggcgagcagggtggcggtgatcgacggcgggggctcgccgatggcgcggaagcagagccacaggccgagcgcgtcgagcagccagttgagcacggcgagcagggacgcggcgaaacccatcgaggggcgcagctgcgcggtgcgcagctgacccaggaaggcggagacacggtcgtggccgtcggtggtggggcggcggcgcaggcggttgaaggcggccagcggcgtacgcacgatgtcgggtttgtgagccaaccgccgggcgccgaggatgagcagcaccgtggccatcagcaggccgagcaggtggcgccagtcggcgtcgccgccggcggcgagggcgctgccggcggtgatcgcggcgagcgcgcaggaggacaaaatgccgctgagcgcgatcacccaggaggcgaccgccgggctggcgccgaagcggcgcatctgctggtagttgagccgggtggagaaggcggcgccgcccggcagggtctcgttgagcgagtgcgcggcgaaggcgagccggacggtgtcgacgatccgggcccggacgccggcggagcgcagcaggtggcgttgcatccgggcgtacgcgttcatcgagacgacctcggcgagcaccgcgagggtgagccagccggggtgtggccggcgcaggtggtgcagtgcgccggccagcgagctccagccgaggaggagttcggtgccgaacagggcgaccagggcgaggaccgcggcgatccgtagccggtggcggcgctgcccggcgacccgtgggggagtggcgtggaccgcccggaccggtacgcggcggggactggccgggctgggcgccggggccgcgtaggtgggtgcgctcacgggccgcaacctctcgggagaatgcttggtacagccaagtatcggcacaggctttcccatagtgcaagttttccggggtggaagagatctacgccaaatcacttgccagcagcgcgctggttgtacttacgtttggcccacacgtatgacagtgcggagatcaccgcgcaccagcccagcgcgatcagagcgctgttcccgatcccggagccgagcagcaggccgcgcagcgtctcgatgaccggggtgaacggctgatactcggcgaacgcgcgcagccccggcggcatcgtcgcggtggggacgaagccgctgcccagaaacggcagcaggctcaggaacatcggggtgttgctggccgtctccacgctgtcggcggccatcccgagcgccaccgccagccagatcagtgcgaacgcggtggcgagcaggacgcccagcacggccagccactcgaccggggtggcggtcgggcggaagccgatcagcagggccacgccgagcaccgccaccagggcgatgaagatctgcaccaggctgcccagcacgtgcccggtcagcaccgacgcccgggcgatcgccatgctgcggaaccggtcgacgattccctcgctcatgtccatggccaccgagatcgcggtgccggccaccgccccggccacggtgaacagcaggatgcccggggtcaggtagtcgacgtactcggcgcggccgccgcccagaccggcgcccagggtgccgccgaagacgtacacgaagagcagtaggaagatcaccggcagcccgatcagcatgatcgtcagcgaggggtagcggcgcaggtgcagcagctgccggcggaacatcgtggcggaatcggcgaaggtggtggcgagggtcgtcatcgggactcctggtggccggtcacggcgaagaagacgtcatcgagatccggggtgtggatggtgaggctttccggttcggcgccggccgcgtccagccgggccagcacggtccgcagcgagccgacgccgccgtcgctgggcacctgcagggtcagcgcgtcgtcgtcgcggtgcacggtggccagcaccgacgccgccgccgcgagcccggccgggtcggcgaaccgcagcagcaggtgcccgccggggatctgccgtttcagctccgccggggtgccctcgacgacgatccggccgtggtcgagcaccgcgatccggtcggcgagctggtccgcctcgtcgaggtactgcgtggtcagcaggacggtgacgccctcgccgaccagctcgcggacgatctgccacatggcgtgccggctgcgcgggtccaggccggtggtcggctcgtccagaaagatcagtcgtgggctgccgaccagcgtcatcgccaggtccaggcggcgctgctggccgccggagagcagctgcaccggcttgcccgccgactcgccgaggtcgaaccgctcgatcagcccggccacccggcggccgcccgcgctccggccgaggcgatgcaggtcggccatcaacttcagattctcccgtacggtcagcagcctgtcgaccgccgcgaactgaccggtcagtccgatcgcggcccgcacgccgtccggctcgcggaccaggtcgtgcccggccacccggaccgatccggcgtccgcggccagcagcgtggccaggatccgcaccatcgtcgtcttgccggcgccgttcgggccgagcagcgcgaacacggtgccctcggggaccgtcaggtcgatgtcgtcgagcacgagcctgccgccgaagctcttgcgcaggccggccaccgagacggcgggccgggtggtgactgtcgctgtcatccggttctccagtttccgggcagggtccatcgccggccgggacatgtcgtcgccggccgggaggccaggggaggggtcaggcgcggtggatcaggatgtcgccgaacgaggtgcgggcgcggatctcggcccgctcgtcggtctcggccggtccgtcggccgcggtcaattcatttcggatcttgccgtacgaggtgtgcacgtcgagccgcgccgcggtgcccgtgcggacccccacctcgatccgccccgccgagctgcgcagcgtggccaccccgcggaccagctcgcgcacctggatgttgccgttcgcggtgttcgcggtgaccgggccggtcgcgtggtcggcgccgatgtcgccgttggccgcgttgacccgcagctcgccgccggcgtgcccgacccaggtgtcaccgttgccgttcttcagcacggccgggccggtcaccgagtcgacccgcagcttgccggagccggtggtgaggtgcgcgtcgccggtgaccgactcggcggtggccagacccatgccggtggtcatgctgaggctctcggcctgctcgacccgcaggtcaccggcgccgctccgcagccggcaggcgccgaacgccccgatgcagcgggcgccgccgacgccgagcttgacctccaggtcggaaccggtgggcacctcgatcaccacgtcgacggtgccgacccggccgaagatgccgaagccggcctgccgtgggccgcgcacgatgagcgtgccggaggcgaactcgacccgggtctgctcggcggcccggacgtcccggtcctcaccggcggaaccgggggtcacggtgaccacggtgtcggcccggtcggaggcgatcacgtgcaggtcggcggcgaccaggtcggccgagacggcgatcggaccgggggtgtcgaagaggggcatgacaggctccgttctcctggagggggtcaccggacccagccggtgtaacgctggccgccggtggtggagccgccggtggcggggcgggcggtctcgccgtcggccgcggcggccgcggcgcggatcagccacgtgttgatcgagatgccggcccgggcggcggcctgctcgacccggcccttgaggtgctcgggcaggcgcaggctgatctagctagctagccgggcgcggcgggcggctcgggcaccggcggctccgaccacgggtcggccgccggggcggtgacgacgaaggtcggctcgcggtggcgcagccgcaggtcgaccgagccgggcgcgaggtcacgggtgatctcggcggccgcctcggacagggcgtcgagcagagcgagccgggtcgcggactccagcggcgcggtcagccgctcggcgagctcacgagcctcctcgccaccggccgcggcggcgacggcgagctcgtgccgcagagcgtcgatgtacgggcgtagttccatgacgccactatgacatcatagtgatgccacgcgcaaccgggttggcgtcaccaggtgcgttcgccttccagggcggcgtccacccaccatggcgccttcatgatcggggacggcggtgccggggggaaagcgtgcaggtcgacgctgccgtcggtggccggatcggtgtcggccgtcatccggtgatgccgggtggcatcaccgatggcaccacggcgaaattcgtcacccgacccaggcgccgggccaggtcgatgccgcgcgccgcccgctgcagcggggtcttcgatgcctccagtgcggccagccgtcgcgtggtggccggctcggcggccgtcttccggtgctgggcgcggacctggccggcgcccccgaccgcggtcagccgcggcaccagaacgacaacgacgatcgatacccgcttcacgatccggcaccgtagtgcccactggctcaagccgccggaccgcacgccgatagagacagtgtgcgtctactcgccctcggggccgccgcggtcctgtcggcgtggtacctggccgcccccggaccgctgaccgcccaggtgatcacctgctgggtggcggtcggctcgtacgcgtcgatgatgtcgtacttcgccttccgggccggcgcgctgatggaccgggccgacccgcgccgccgcttctggcgctccctcgggctcgcggccgcgacctgggccgcgggagagtgggcgcagatcgcgaccgcggtggccgacccggactcggtcgccgcgctgaccggcaccggcatggtccgcaccatcgccctgagcgtgggctgcctcggcctgaccggggtggtgctcacctatccggtcgggcaccggtcggcccgggcccggctctgctacctctacgacctggccaccgtcgtcaccacggcgggcgcctacggcctgtgctgggcggcctccgccggcggaggttcggggttcgcctacgacatgttcaccgtcggcgccgccccggtggtggcgatgctgaccgcgttcgcgatcggccggctctacctcagcggggcggccccgttccgctggccgctcggcgtgctcggcccgttcgccgccggcgtcgagggactcgcccgcggactcggccccgaactggtcagaagcgggcaccccggggtgatcttcgcactcaccgtcaccgcgcacgcgctgctgatgatggccgcgtgggcgcagtaccggaccgtgcacgtgctgcccgaccgggtgcgggaccgcccgtacagcctgctgccctatgtcgcactggccgccggtttcgccctgctggtcggcacgctggcgttcgacggcctggaccggcgcgcctggatcgcggtcgccggcgtggtcatcggcaccggcatcgtggtggcccggcagctcaccgcgttcgtcgccaacgccgaactgctcgccgaacgcgacgccctcgccggccgcctgcacaccatggcgttcaccgacagcctcaccggactgagcaaccgcgccctgttcctcgaccggctcggcgccgcgtcccgggccggcgtcctgctgatcgacctcgacgacttcaaacccgtcaatgacgtgtacgggcacgccgccggtgacgccgtcctcgtcgaagtcgccgcccgtctgcgggcggcgaccggcccggaccaggtggcggcacgcttcggcggcgacgagttcgcggtcctggccaccgacgcgaccgccggtgacctggccgcgctggccgaacggatcgtccaggcggtcggcgagccgtgccggctgccggacggccgacacgtgcgggtgcacgccagcatcggtgtggcgaccggcgacgggcgggacgcgaccgccctgctgcacgccgcggaccaggcgatgtatgccgcgaagtgcgggggcaagggctcctatcggctggccccgacgggctgatcgtcggccgtcggcgtttcgtcgtcggtcgggggccggccgccgctttctcgtcgtcggtcgggtggcccgccgccgctttctcgtcgtcggtcgggtagcgggccgccgctttcccgtcatcggtcggttccagggtgtagcggcggaagacgagtgcggcgggggcgaagccggccagcatccaggacgccatcgtgagcatcgtcgatgtggtggcctgacctcgccgcctcgccgcctcgccgcctcgccgcctcgccgcctcgccgcctcgccgcctcgccgcctcgccggctggctggattgttgcgttcgccgatccgcccggccggtgccgagggaccagcgtcggccgggtggtgccgagggatcagcgcgccggccggccggtgtcgagggaccagcgtcggccgggtggtgccgagggatcagcgcgccggccggccggtgtcgagggaccggccggccggatcggtaggacgcgactactcggtgcgcagcgcggtggcggtgcgggtgcgggccgcccagcccgccgggagcagggcggtcacggtgggcggtcgtacaccgcaagcatggtgtcgggcaggtgcaggccgccgctgccggtcatggccgggacgaccaggataccggccgttcgtgctgctggcgcccctggtcgcggctcggatcctggggaaggtgagcctgcgcgaccgggtcgaggccgtggtgacggcatacgagacggggccggtcagccccggcccgcccacggagtagcggctttcggccggcctgcgccgcgatgggcacaggccggccgggatcagccgaccttgatgacctgggtgccgccggcgaacttgtcgaaccagtgctggcgctgcgggtcgctgttgatgccgaccgcggtcagaacggccgcagcgatcgcggccagcacgctgatgacgggaccgaggatcgggacgatgttcaggatggcgaggcccgcgtagatgttgcggcggatggcctgctccaacgtcgggttgctggcccggtcgggaccgtacacccggagcttcatcacctgcttgccgatcgtctgcccctggctggactccatgtaggcgaagtagcccaggaaaaggaccgcatccacgaccgccgagaggaaggtgctgaggaaccaggagttcgacaggatcccgaggatgacgctgatgacgctgaccacgatggcgacgatgacgccgtcgatgagccgggcgacgaaccggtcgatcaggttgccgggctggccgacgccggtcccgggcgcgccgtacggggccttcccgtattcgggctgctggtagccgggctggccgtagcccggctgctggccgtagccgggctgctggccgtagccgggcggcgggggcggcggctgctgaccgtaaccgggcggggcggcggctgctgaccgtagcccggctgctgcccgtagccgggcggcggaggcggcggctgctggccgtaaccgggctgctggtagccgggctgctggccgtagccgggcgggggcgggggctgctgcccgtaagccggctgctgcccgtcgaacggatcggggctgctcattacgtttttccatttctggtaggtttggctcgattgcggcgcgcgtccttcggaaaaagaccgctcaccgttcccggggcttcacgtgaacgcacatcgtgccatgatcgaggacgtccgaggaatcgggtcagacatctgacttgctggtcagggccagctcgcgggtggagatatcgcgcatttcgactttgcggacctttccggtgacggtcgtcgggaattcgtccaccagccgcacgtaccgcggaatcttgaagtgagccagccgcccggcgcagaaagcgcggacattcgccgcgtccagcggcgtcgcgccggggcgcatccggatccacgccatcacctcctcgccgaacttctcgtccgggacgccgatcacctgcacgtccaccacgtccggatgggtcagcaggaactcctcgacctcgcgcggatagacgttctccccgccgcggatcaccatgtccttgatccggccggtgatccgcagatagccgtcggcgtccatctcggccaggtcgccggtgtgcatccagccgtccgcgtccaccgcctcggccgtcttctccggctgcccccagtaaccgagcatcaccgagtagccgcgggtgcacagctcgccggactcgccgatcggcaccgtcgcaccggccgggtcgacgaccttgacctgcaggtgcgggcccacccggccgaccgtcgacacccggcgggtgaggctgtcgtcggggcgggtctggcaggagaccggtgacgtctcggtcatcccgtagcagatcgacacctcggtcatgcccatccggtcgatcacctgcttcatcgtctccaccgggcagggggagccggccatgatgccggtgcgcagcgacgacaggtcgtacccggcgaagtccgggtggtgcagcatggcgatgaacatggtcggcacgccgtacagcgaggtgcatttctcctcggcgacggcccgcagcgtcagcgcggggtcgaagcccggcgccgggatgaccatggcggcgccgtggctggtcgccgccaggttgcccatcaccatgccgaagcagtggtagaacggcaccgggatgcagatccggtccgccgccgtgtagtcgatcaactcgccgacgaggaaaccgttgttcaggatgttgcggtgtgacagcgtggcgcccttggggaagccggtcgtccccgacgtgtactggatgttgatcgggtcgtccgggtgcagggtgccgccgatcgcgtcgagaacccccggctccggcgcggtgccggtcagcgcggtccactgctcctgaccgatcaggaccacgtcgatcaggtccgggcactcgtcgcgcacctcgtcgatcatcgcggcgtagtcggacgtcttgaacgacggcgcggcgatcagggtgcgaaccccggactggcgcagcacgtagctcaactcgtgggtccggtacgccgggttgacggtgaccaggatggcgccgaggcgagccgtcgcatactgcaggaacacccactccgggcagttcggggcccagatgccgacccggtcacccgtgccgaccccgagtgcgcgcaggccgagcgcgacggcgtcgaccgtggcggtgagctcggcataggtccagcgccgcccggacaccacgtcgaccagggcctcccgctcggcgtagcgggcggtggtggccacgaggtcggcgccgatcgtccggtccagcagcggcggctccgccggtccggtgctgatactgagctgctgctgcaccacgagtgcctccccggatggtggtccaagccacatcttgacccgccgcgccgcaacggtccacccccggccgggccggctccgggatgtcccggccgacaagtgtcaaggagtggacagttgtcccgccccgagcggaacggtgatgttgagtggtgccgtgactgcacaacgccatcagttgatcatggtgggttttgtcacctggacgaacccgccaggcgggaactgccgcaaccagcttttatgctcgccgaacggcagctcgcccggtccgcatgtcgcaggcatgagcgcgcggtcggactgcggcgaagaaagggatgcgggtgcggccggacagttccgaggacgatgacgacgaacgtcccgctgcgggcctcgacctgtggcagctcgccggcctccccggcggcctgctgcaggcaagctatctgaccagccggtttgcggcgcagtaccggctgatcgtggacgtgctgctggccgagcaggaacacacgctgaccggcgtcgccgccaccgaactgcccgatctgctgcgcaggcgcctgcgccacctcggcgtcgacacggccctgctcgatgatcccggcttccggctcaaggaacggatggcccggctcgaacgctggggtgtggtgtacacgttccaggacaaagccgtccgggacgctgaattcgtcctcgaccgagaccggtaccagctgaccgagaccgtcgcccagctgcaccgggcaatcacctcgctcggggatgacagcgcggccgaagccgccgccactctcgcccccggcatcctgaccgcgaacctgaacctgctgtacgagtacgcccgcaccgacccggccgcagccgccgcagcctggtcggtgatcgccaccacgcatcagtcgatggtgaaagccgccgccggctggcaggcccgcctcgccggggccctggccggggccccgacgccggaaaagatcaccaccgtgcaggagacgctgcgccgctacgtcgacatgtggggcgccggcatcgacacccactccgacacgatcaccacccgtgccgggaaactcgccctgctcccggctggggtgtggcggcgcatcgccgtacacaccctcggcaccaacgccgacaacccggcgatcgacgccttggtcgacactcaccagcacaccctgcaaacgctgcggcgctggttcgacggcccggactgccaggcccgcaaactacgccggcagatgcgcgacacgatcgggccgctcctgcgcgggcagcgcacccttgccgcggtcggcgggcacgtctcccggcgtgccgaactgctcgccctggcggcacgcctggaatcagccgccgacgaccacgccgcctggcgactgtggtgcgccgccaccgggcttttctccgcccggcacctaccgggcgagacgaacccgccggccggcagcgccggcgcggtgtcgttctgggaagccgacccggtcccgatcgaagcacggctgcgtaaacaaggccccaaagccgtgaccggcaccgcagcccgcatcgccgaccgcacgggcgccaaacgcgccgcccgggaacgtgctgcccgcatggcagcgcacgccgcgctcaccgaagccgcgatcctcgcccggtccgggcagcgactctcgcaatggcgcaacgtaagcgccgatgagctgcagatgctgctcgttctgctggccacgatcgccgcagcccgccccgacccgaccggcatcaggtcggcgaccaccggcgacgcgcgctggctgctgcacgccgacccgccaccagacggcgcacccgccgcgatcgtgcacacccccgacggacgcctggtccaccccgacatcgccctgcacatcaccccggccgggagccgcccgtgaacaccgcgacctccgccgtcgaaaagcaggcccagcaggcattcctcggtctgctcgcccaacccctgatcaccccggccaccaaccggatcctgcaccggcacgtgctgcgccaccaacgccagatcaccgaccacgctcgccgcgccggctaccgcatccaacgcgtcggccgcgccgtccgtctcatccgggtaccgatcggcggacaggtcaccgcaccaccacgccccgccggcgcgcccggccggcgactgctggcactggcgtgctgcctcgccgcctgctgtgaagaagtctcgaccaccgtcaccctgcagcagctgtccgacatggtccgcgacctgaccggcgccgccgggtccaccgtcaccggctacgacccggaactgaaaccgcaacggcggctgctgcgtgacgccgccaccctgctcgccgactggggagtgctacgccgccgcaccagcgacgaaatgctgctcgactggaccgaagacggtgccgggcccggcgccggctatgacgtcgaccgggacgccctgctgctgatgaccagccccgacgtcctggccgcggccctgcacaccgccgcggccgatgctgagcagctggccgcgacccgcaccgtgcggcagctgcgagagctgctggaaacccccgccgtcgtctacgccgacctcgacgaacacgacgccgacgcgctgcgcaaagcccgcggcctgcgcaccgccgatctggcgcagatgaccggcggcacggtggaagcgcgcgccgagggcctgctcctcgtcctaccggatgatcccgaccggcagccgagcgtcgtcgactggccccgcgcccgcgccgcggactgggtcgcgctgctgatggccgacctcgccggccgccacggcgcccggacctccaccggcacggtccgactgaccggcacacaggtcgacgaggtcgtcgacgaccttgtggcatggcgcggcgactacatgtcgaaagaccagaaaaccgtgcccggcagcgtgcgcgccgacgccgaaacgatcctgaccgaactcggcctgctccaggtcggcgccgacggctcgtggacgttgtcaccggtcgcagggcgttaccgggaccccgacatcaccctgatcgacaccacggagcccacccgatgacgatgatcgacctgcccgcgccggggccggccgccaccgacgagcaactggccgcctggcgtgacgccgtgaccaccgccggactccccgccccgtcccgcagccgctggcaggtcctgcgcgcaggcgtgatcggactgtgggaattcgacgtcgccgagtactggttcgctgacggccgggcccagttcgtcggccagaaccagtccggcaagtccaccatgatggccttgaccacgctgctcatgctcgccggcagcctcgaccgcaagtacgtcgacaccttcggcgagtccgagaaggaataccggtactacgtcgaacccgtcaccgacgaccgggaccggcgtgacgcctccacctcgaccaaccggggctgggcctgggtcgaatacggccgcgtcggcccgctcggcgcccccgaattcttcaccaccatgctctacacccagaccaaacgcggcgtgaagcagatgacccgggcctgggtcgtctgccgcggcaccgcccgcgtccgcgacggcctggacctggccgtcggacaggcggtcaccgagcccagggaactcgagggcgtcgacgggctcactgtctacccgaagggcgcggactacaccgagcggctcgccaccgacctgttcggcttcgacgacaccgaacgctatgcgaccgtgatcgagatgctgaaggtgctgcgtaccccacacctggggcagaaactcgacccggcctggttcacctcccagatccgttccgcgcttccgccggtcgcgaaaagcgaggtgaccgagctggccaacggctggcaggaactcgaacagctggcccacgaccgtgaccacgccgacgaagcccgcaaggcgatcaccgtctacctcaaccgggcgtggcggccctgggccgatgccgtcctgcggctgcacgccgacacactgatcgccgctgacgctgcgttcatcaaggccggcgacgacgccaccgcggcggaaaggaagcttgagcaggcgcgcgcccgcctcaacgaggagactcagaacaccatcgacctggagaaggccctcggacggacccgcgccgacctgatgcagctgctgcgctcatcggcgtacacgaccgccgttgaccgcgccgacgacgcgaaacgcctgcgcgccgacgccaacgccgctgctgagcgcgcccgcaaggccaccgcccaactggccacgacccgcgttgacctgcagaaggcaaccggccgtcgcgacacgacccgggcagagctcggcgttgcccgagacgaggtcgagatcgcgggcgggcacgctgtcgaggccgccaccgccgccgggctcggcgaacacgcaccggcctgggcagccgccggcgacgtggaccggttcgacgccgcaatcgccaaccgccgcgggcaagtcgccgctctccgcaaactcatccgcgccgccagcaccgccgccgcgacctggaacaccctcgacgacctggcgcagaaggcgcaaaccgaactccacaatcggacggccgcagccaccgccaccgagaatgctctgcagcaagcggtgcagacgctgtcggacgacctggaacgctgggcttcggcactcgacgaatgggcgccaccgaccgagatccgcacccagtggatcaccgccgtcaccgaccagacccgcgtcgagcggccccgggaactgctcaccgccctgctgacccaccagtggctcgaaccggtcaccgtaccgctgatcacccgcgccgccgacctgcgcgccgccgcgaaaacggccacccaccaagcagccgcggcggacgccgaagctgaccggctcgccgccgccggcgaccccatcccgagcccgccggcccgctggacccgccgtgaacgccccgccttccccacagcggcgggcgccccgctgtggcgactgctcgatccggtcgacgatctcgaccccgccgtcctcgaccatgtcgaggcggccctggccgccgcgggcctgctcgacacctgggtcactcccgacggcaccttcaaccccgagcacggtgccgacgtcgtcatcaccaccggcaccctgcctgccgcgacaacctcgctggccgccgttctccaacccgccgaagacgccgccaccctcaccgaggccgtcacgaaggtcctccacggcatcggctacacccctgacggcccgctcaccacgaccgtgtgcctcgccgccgacggacgctggcaaaccaccgccgcagccggccgggcagcgcccgccgaacacggcgctgcattgatcggcaccgccgcccgcgccgcgacccgccgccgcaacatcgcagaactacgcgcacgggccaccgcgttccgcgacgaagcgcagcgcctcgccggtgaagcagacaccgtcagcacccgcgtcaccagcctgcgcgccatcgccggacaggcacccaccgacgccgacgtggtcgctgccgccgccgctcacactgccgcgaccgccgaagccgagaaggccggcaccgcccaccgcgacgcccgcagccgcgaggcgcatgcccgcaccctgtcgcaggagaagtcagcagaggtcacccgctacggcaccgacaaccggctgcccaccggagaagaacaccttgacgcacttgccgcggccctcgacaccaccgccaccgccgccggcaccctgaggctggcactgcgcgggctcaccgccgccaccgctgccgcaaccgatgccgccgaccggttcatcaccgaagaggatcgggtcagcgccgctaccaccctcgccgaggacgaagcggcagccgccgaactggccgacacgaacgcgaccctggccgaacaattcgtggacgccgacgctcaacagctgttcgcccaggccgaggaactcgaacgcagagtcgaggaatacggcccgtcgatctcagccagccgacgcgaaggcctggcccgctccaaagaggcaggcgaagccgagaacgcctggaagagcgcctgcaaggaccacaccgcagccggtgaacaccgcgacgtcgcagccaccgcctggtggacccccgtcgacgccggtctcaccaccgcccgcaacctgcccaccccggacagccgcgacctgcccgccgcgcctagctagctaggctagcccacgcccgcaccgccaccgagcacctacgcccgctgacgtggcccgaccgcctcgacgacaaagccaaacgcgccgaagccgccctctcccgcatgctcggcagcgccctgattgaccttcgcaccgttctggaagcccacggcggtcgctccgtcatcaccaccgaagccgacgaacagcaccccctgccgtcggtcactctgatcgtcgatgcctccggcaccccgctcgaccccgccgaagccatcctgcacctgcagaaactggtcgacgacctgtcgcgcacccacgacgagaagctccaccagatgtacaccgaacttctctcgtccaccttcatcgaccacctcgccgaccggatgcggaaggtcatcaccctgctcaagatcgtcaacgatgtcctcgagaaacacccgaccggcgccaacaagaccaccctgcgactgcgtcgcgtccccgcggaaggccagacccccggcttcaaaatcctcaaagcactcctggacggcaccatcgaatccgacgccgcgcaacaacagatccaactgttcctcggcgcccgcctccgcgaagcccaggaagccggcctcgtcgggaccgaagactggaccgaccgcctcgctgaactcctcgactaccgcgcctggttcgacgtggtcgcccaatacaaggtcggcgacagcgacgaggacgagaaccgatggaaggacctcaccaggaaagtccacggcgtcgactccggcggcggcaaagtcgtcaccctcctgcaacctttgctggccaccctggtcgccctgtactccgaatccccgaacgcaccccgccccctctggctcgacgaagccttcgagggcgtcgacccggccaaccgcgccaccatgatgcggatgctcaccgacttcgacctcgacttcctgctcgccggcccggcacccctggtcgccgtcgcgcaagtccccgccgccgcagtctggatcatcacccgcgcacccgcacccatccccggcgtcgacctgtccctgatgctgtgggccggccacaccctcgaacagatccccgtcggggactacgccacccggctactcaccccacgccgcagcgccgaaaacctcggtcccgacctgttcgcggccatgctcaccgacccggcaccggccgagccgtcgcacaccaacggagccgaccacaccgacaccgagcagacatcggacgcggccggcatcggcgaaagcgagcccgcatgagcgcggcaaccgaccgatgggccgcccaacccggcccccggaaggtcctcaccgccgtccgtgaactgctgcaggaacgccgcaccggcaacggtgtcatcgtccgcgtcgagctcaccgcgacgcaacgagcccaagtggcccgctacctcggcgtggcgtgggacacctccggtcagcccgtgaccctcggcagactccgtgccgccctcctccgagccggcgacgacctgctcgacctgctgacccgtaccggcggcgccatcgaggacgttcgcggccgccgtgacgaagccgccgcccgcgccgccgcccgcatcgacgccgcctacaccggcctcaccaccgcaggcctacccgatcacgccgtccgcctggcccgcaaacgccgctggctcggcaccgaccccgagaccgccacccgccgctccgacgacctgcaacacctgtggcaagcgttgcccggcaccggccgtcccctcgccgaaatcgccaactccctctacggcgacccacaccgcctcgaccgcgaccacgacctcggccgcgccgccgcccggctactcgcggccgccgcggccgccgcggacgatgacgccgccttcgccgccgacaccgcgctgaccgccgaccggtggcggcaggtgtggtcccagtacggcatcggctgcgacgaagtctccgccaccgtcctggtcctcaaccttcccctgatcgggaaggcaccggccgcccggatcgcgggcgcggcagccgtacacggcgaaccggtctggctgaccagccgcagcctgcgcggagactggacacccggacccgacctgaccgtcgtgcgcgtctgcgagaaccccgccgtcgccgaggccgccgccgaccgactcggcagcgcctgcctgccgctggtctgtatctacggacggccctcatcagcagcctggacactgctgcgtggcctcgccgccgacggcgtccgactccgggtcaccgctgaccgtgacgccgcgggccgcggcttcctcaccgagatgctcgccttacccggcgccaccgaatggctgcccgacgccgacgggctgtacgaggaagcccggctggaagccctggtggccgacctcgatcccatcacccgtgccgccggtgacagagatgatcatggtgaggggcttttgccgggccccgatccgaagccgacaatgggcttcgactgagctttcctcatcctgcgcagcggctggctgggacgtaatgcaagacgcgaggaagtccagggcgttatagggagcagccttgtcgcatttcggggtttacgtctgcctggctccgggggcggaggcggactggcaggcggccgtcgccgcggtgatggcgcccttccggatcgacgacgagaccggtctgggggagtgggaccactggcacccgtccgggcagtttctggtccggccggagtacgcggacagcccgctcatcctgcccagcacccgatggcctgccgatccgctgcggtgcgacggcggcccgaaacggatgctcgatctggaagggatgcggacggcggcacgggatcgggcgggacagctgtgggccgcctggcgggaggcggtatcccggcatccacccgcccggtccctcgagacgtgcgcgtcgcgggaggcgtacgaggcgcaacccctcatcgcggagatccgggcccgcagcgacgacgagggcgacgtcttcggcctgctgtggaccgacggccgggacgaggtcacctaccttggagacgacgagcagcgttttctcgacaccgccgtcgagtccgcgctgatgacgtacgcgctggtcacgcttgacggccgatggctggacatggagcagacgccggcgttcgcctcgctggtctggccctgtctggaaggcctgccggaggacgccttcgtcatcgagctcgactgtcactgttgattgtcggtcggcgggtgcacgggaagcagccccgcacgccggtccgtcagggggccggcgacacggcggtcagcccagcatcgttgctcgtcagatggtccacttcccgcgcggtcgatcagggtcgacgcgcggcggcgatttccgggaagccgtttcgcctagggggttgtgccttcacagatcacgccccccgggttggtggtctccgcaaccttttcgccgtcgaagaacatgcgacaggtggcgtttccgggttcgctcaaggtgaccgctacggctacgtactgctgggacttcttgaaggtgacggtggttgaccaggggaggccggctgtctctccgagcgaggccggcaccttggaaatttccgagctcgttccattggtccacgtgatcatggtggcggtcttgctggtggcctcgacctcgtagcggaccttgaggccagacccgtcccgcacgatgaacatcaccgccgccgcggatgctgccacgagaacgaccgcgagcgcgaccaggtaaaggcgaagcttggaatgcggtgacgtcgacgccggtgagtccgggctcatttctcttttcctgtcgggtatgtgccgacacttcgtgcatggcggctggttgctcgccggtgccggcccgctgcgggccggcaccggcgagggccatgcatcagcggtggtaggtgcgccggctgctgtactggatgttgccggcgcgatcgtacgcccgcagttgcacggtgaaggtcttgccgtacctcgcggggttgagggtgaacgcgtagccggcgcgggtgtcggtggcgaccggtttgccgttgacgagcagctcgacccgggcgatgccgttgcggtcgctggcggcggcggtcaccgcggcgcttccggtgagtttggcgccgttggcgggtgccttgctgatcgcgatggcgggtttggtgttgtcgacgacgacggtccgggtggcggtgctggtctggcctcggcccgcagggcagccctccgggcggccacgcccgaaaatgtcacaccgcacttccagcctcacgacgaacggaaagggcatctgcgaccctcgtccgctgcggctgaccggcggcgacgtccggagaagcgtccaaaagtttcacagcatgacgcattcctgaaaacgctctcccgtacggtctgcgccgtgacatccacgattctgcttctcgccgttcccggctttctgacgctctacttcggattcttcgctgtcttcaactacacctacgcgttcggcgcgctgacccgccgccgcccgcccacggtcccgctgccgctcgacgcggcggtggcggtcgtcatcgtgtcgttcaatgagcgcgaagtgatcgccgacacggtggtcgcgtgtgagcagctgacctatcggaacaagaccatcatcgtcggcgacgactccaccgacccggaaacgatcgccctgctgcggacactggctcaagagcggggctgcacgttggtacccggcgcccgttacgccggtagcgacatcgagctgtgggaatcggatcggttcgtcctgttccaccgggcggagaacgtcggcttcaaggcgggcaacctgtcgaccatggagcagtatctccgacagcgtggcttctcccacatgtaccttctggatgcggactggcgtccccaggccgacgccgtcgagcgctgcctcgaggtgatcgccgccgacccggccacgggatacgtccaggccaagcgtctgtatcactacggccgtagcgaccacttccagcgctgtctggccctcaacgaggaatcttgctatctgtccgacctgcccggccggcagcggtggaaccacatggtgctgttcaccggttgctgcgcgatgttcgacctgcgggcgctgtatgccgtgggcggattccgcgccggtcacctgaccgaggacatcgacctgtcgaatcgtttctacctatccggctatcgcggcgtctacctggaagacgtggccaatctcggtgaggtgccgccgaattaccaggcgttccgtcggcagcaggagcgctgggcgatcggttcggcccgcaccttcaaggagtacctgctgcccgtcctacggtcagggctcgacctgcgcaccaaatggagcctgctgcgccagaacgcctactacaccgccgccttgggcgtcgagttgtccgtggtgtggagcctgctggtggtcgccgtcgcggtcctcggcaccggaccaggctggccggcggccgagcccggtgagctgctacgcgtcttgggatacgggctgggaccggtcatgctcgtgacgctgctcagcggcgtcgcccccctcgtcgtcacgaccatcaaaaagcgcgaatggatcaatcttctctacatcccggtcgctagctggatcgccctgtcggtcgtgcacacctatgcgatcgccaacatcaaggggttccgcaacacggcacagtcctggttcgtcaccccgaagacaaaccgtaagaagggcgcggtacgcatacgcgcggggcgtcgtatgcgggcgttcaacatggtgacgctggtcgccatgaccgccacctatctggccgtataccaccacacacccgacccggcgtcgctcgcgctgctcgccgtgtacgccgcgctctggctgccgtcgatggccatcgccgccatgaggagctgaaacgccgccgtggccgccgaagtccggggcgcgaggccaccgaccgactcgccgccgtgaagcgcacgcgcggcggagcgatcaccggccgcgcccgcgccgagcgacaggcccgggacgccggcacccgtgccggggcaccgtaggaggtcgcccgcgacagccgacttgccaactgcgcgagcacctcgccgccgtccggcgggaaccggccagcacccgggaccgggcactcaccgccgaaaccgcggccggtgatcgcgaggtgcggggacagccggcaaacacccgttgtttggtgcaatgactgtcgacggcgttgatccgatccatgctcgtacgtcaaacgggaaggcaatcctgatcatccatgggtccggtgccctgcaggaggtaccggtctgatcatgtgggtgttcggccacttgcccggtgatgacgtgatggtgtccggccggcgcagccctcggcgggcagagcgacggtggggcccggcgccgatggacctcgccgaggaccgactggccgatggtgcgggttcgccgcaaggatctctcggccgacaacggcgtcctctgtggaatccgatgatagaaacgtcgtatgtcgggtgaagcatcatcgatgtccggtgccggcggacgcgggttggtcggccggcagggtgagctcgacgccgtccgggcggcgctcaccgagctcgggtccggtgccggccgggccctcgcgttcgtcggggaacccgggatcggcaagagcgctctcgcggcggcggcggtgtccctggcccgagcggccggggtcgatgtcgtcgcggcgcgcggcgccccggtgcccgtcccggggccgcgacggccggtgctggtggtggtcgacgacctgcacgaggtcgccgacgcgcacatcgaccgggtcgagcgtctggtggcggcgaccggcgccgggccggtgctctgcctgctggcctaccgcgagcggcagatgtcgcgggccctggccgcggtgctcgccggcaccgtgcccgccggactgctggaacgccgcacgatcggaccgctctccgccgagcagtgccgggagttgctcggcgaccggcccggcgtcgaggcggcacaccgggcgagccagggcaacccgggttacctcgctgttttcgcggggcagccggacgccggcaccccgatcctcggtgagctggcccgcctcgaccgcgccgccctcacgctggtgcgtgctgcggcggtgctcgagcagccgttccggccggagcttctcgccgaggtcgccgagttgccggtgcccgcgacgctgacggccctcgacacgctcatgcgactcgacctcgtccggccggccgagccggcgccgcacctcgcgctgcggcacccggcgatcggcgtggtcgtgtacggccggttggagcccagccaccgcgcggagctgcaccgccgcgccgacgccgtgctggccgaccgggcggccccgatcgcgctccgcgcccaccacgtggcgcgagcggccgacctgagccggccggacgacgtcatcaccctgatcgcggcggcgcggggaatgctctacggttccccggccggcgcggccggttacctgcagaccgtcctgccgttgctgcgcgacggcgacccgcaccgccacgaggtccaggtgctgctggcccgggcgcgcctgctgaccggcgaggcgtccgagggccgggcgctgctcgacgcgttgcgctcggcaccgccgcgccgggcgcccgacgaggcgcacgcgctggtcgactccagccgcatcgagcggcagcgcggccgctacggcgaggccgcggccctcgcgcgggccgggctggccgccttggccgaccgcgacaccgggaccgccgcggcgctgcacaccgaactcgccgaccatgcctacaacctgggtgactacgagacgtcgcagcagcacgccgagaccgcggccgccatcgcccgccgccaccacgacccggtcggcgaggcacacgccctggcccacgcggcgctcgcccagctgttcaccggccggcaggcctgtgccctgcggaccgcgacccgggcggccgacctggtcgacgcggcacccgacgccgtgctgctgaccaacctggaggccgtgttccagctcggcatgatggaggggatgctgggccggctcgcgaactcggcccggcacctcgagcgcggcgtcgacctgtgccggcggaccggtcagaactacatcgagccggcgatgctgaccgcgttgaccaacgcgcgcctgcgctccggcagcctgccacaggcgctggcgacgttggacgagcccccgcacccggtcgaatgggacgccaacgcggccaccgaggcgatcacggcgatgctgcgcgccaagatcctgttctggcggcaccggcccggcgacctggccgaggcggtggcgcaggccgatcatgcggtacgcctcgccggtgacaccccggagtcgtgggccgtcacgatccgctgcttccacgccgaattcgtgctgctgaccggcgacccggcccgtgcccgctggctgatgctcgacgcggccggcggcgccgacctgccgaagctgaccgcctggcggcgcccccgctggtgcgacaccctcgccgaggcggcggcggccgagcacgacgaagccgcggtgcggcactgggccgagctcgccgaggtctgcctgcggcagctgccgtcgaccgaccggcaggggttcgcccggcgcgcgcggatgcgggcccatgcactggccggtgaggtcgaccgcgcgctcgccgccgggcgcgacgcgatcaccgacttctcggcgggcggggagcggatcgaggtgggccgcacgttgctcaccacggccgcggtggcgctggacgccggcgacaccggcgaggtggcccagtggctggaccgcgccgcggtgctcgccgaccggtgcgggtcggcccggctggccgaggaggccgcgaccctgcgcggccggttcaccgaaggtggtgcgctcgcccacctcacctcgcgggaacgtgaggtcgcccggttggccagcaccggcatgaccagtggcggcatcgccgaagccctgttcctgagcgtgcgcacggtcgacggtcacctgggccgcgtgtaccgcaagctgcaggtgcgcaaccgggccagcctgatcggtgctctccgggccggtgtcacaccgcgaccgcggtcaacgccgcccgcgacgtgacccgcagcttgcggaagatgcgggtcaggtgtccctccaccgtcttgaccgagatgtacagctcacgggccacgtcccggttcgtgaggccggccgcgaccagggcacagatgcgccgttcctgctcggagagcacgtcggcgcagccccgggaccggcccgcgccgatgcgacgctgcacgttgaccgcgaggacggcgagccgggccgcgccgtacgcgtccgcgaggttcttcgcctcgcccacgctcgcggccgcctcgtcgagctgccgcaggtcgacgaggacccggccgagcagcaggcgggcgcggatctcggcgggcaccagtccggcggtggcgaacgctgcggcggctagctagctaggcccggccgggccgcccgggccaggtgcggagcccgggcgagggggccggcaccgcagcggtgcagggcccgatccgcgcgcgcgttcgcggcgatccaccatcccggtggcgtccggcggaccacggcgacccgcaccagggtgtgccggagggtcaaccggtgatgcgatccgtccgagcggacgaggtcccgggccgccaggccgtcgagcgcggcgagcgcggcccgctcgtcgagctcggcgaccggcgccagcaggagcgggtcgaacgggtcgcccaggacggcggcggcgcgcagcaccgcgagctgatcgccgtgcaccggcgcgaggtcgcgggtcagggcggtgcgcagatcctcgggtaacgcggcggggtcaccgccgcggcgctccagttcgcatgccacccgcagatagagcggattgccgccgctggcggccaggtggcgcagggccggaccgtcgccgaacaaccgcgtggccgccgcctggtcgagagcggccggagccaggtggacggtgcggaaaccggcggcggtgtcccgcaggaccgtctccagcgcaccggagacctgacggggccgataggcaccggccaccagcagagccccggtcggcggacgccgcaggagccggctgagcaccgccaggtcgtcgtcgtcggccgcatgcagatcgtcgaggcacagcacgacggcgcgtcgaccgccggcggcggagcgcaggccgtcgacggcccgcgacaccggggagtcgccgggaaccgcccgcccgaccggcgtcgcccgtccgcggagcaccgggagcccggccgcgccggccaaccggcccagctcatcgagcagcgcggtcttgcccagtcccgggtccccgccgacggtcaccaccacggacccgccgccggcacaggtggcgacggcggtgatcagggcgtcgagctcgctgtcccggccgacgagcggcggctgtgaggcatcggcccgcacggcggtcacctcccttcaccgtcctgcaccgtcgcggaaacggtcccagagacggccgggccgggaacaggcgtggaactacccgatccggctacgtaccgccggtacccttgcccgccgccggccgggaaacaagggtcccgaccctgatgctgtgcgccgccaccgctgccagattcattgccgggagccgccgatgcggcgggtcgaaaggcgggcaatcgcatgggcgagtttcacttgcggagcatcgtggcggcggtcgtcgccgtcgacggcacgcagggctggtcgttcaccgaggacgacacctggtgtcacgtctgtccgccggacggcaccgcggtagcgcgggtgcaggggtggaagctgcacgtctcggccacccggctgtccgtgccggaggtgctgcaccgctgcgccggggtgctggtcgaacgggcctgcgccttcaagttcgcccgcaccgccgagctggtcgccaagctcaccaacgagcggtacgaccgggcccagtgcggcaagatcatcacggtctacccggaggacgacgatcagctgcgggaggtcgccgccgcgctggatgcgacgaccgcgggcatgcgggggccggccgtgctctccgaccggccgctgcggccgggcagcctcgtgcactaccggtacggcgccttccagggcgtccgggtgctgaccgacgacggcgcctaccaggtccggctgcgcaccccggacggccgcacgatcgaggacgtccgggcgccgaggttctccccgccgccgtgggccgagccgccctatccggcaccggccgccccaccggcgagcaacggtgccgcgggggctcgcacggtggtcctgggcgaccgtttcgaggtacgtgaggcgatccggcacgcggcccgcggcggcgtctaccgcgcgtgggaccggcacaccgagacgatggtgatcgtcaagcaggcccgggccgacgtcggccagcgtccggacggccgcgacgcccgcgacgtgctgcgcgccgaggccgacgcgctcgacgcgctggcgggcatcgcccccgaccggctcgccctgttcgaccagaaggaccacacgttcctggccgaatccctggtccccggcacgaccctgtccgcgtggatccacgaccggctcaccgccgccgggccgatggccggccccgcgccggccgacgcgctggacatggcgtcgcggctggccggcctgctggccgaggtgcaccggcggggcctggtcttccaggacttcaccccgatgaacatcatggtcaccccggacgggtcgctgcggctgatcgaccccgaactggtggccgtgccgggcgcctgggcgctgcggggacacacgccggccttcgccccgccggagaccgtcgacgagatcgggccgggccgggtgccgcaacagagcgccgacctctatgccctgggcgcggtcctgttcgtcctcgcgctcggagccgcgccgctgttcggcacggaccagcccgggccgggctccacacacgaccggatcaccgcactgatcaccgccgcggcggtgcacaacgccacggcccgcgccctggccccggcgatccggggactgaccgccgacgaacccgcgcaacgctggagcatcgagcggctgcgcgcgttcctcgacgaccgggcggcgacgccgacgacggtgctccgcaccgggccggccgagggtacgacgtccgaccggctgccggccgccgaactggacagcttcgcccgggacgggctgacccacatcgtgagcaccgtcgcgagcgagccggatgccggccggctgtggtccagcacggccttcggcaccacggccgacccgcactccgtgcagcacggttcggccggcgtgctcagcgtgctggtgcgggccgaccagcttctcgaccggcccgacctgcgcgccgtgatcgcccgggtggcggcctggaccgggcgtcccggcacggcgccgcggctgctgcccggcctgtacttcggccggtcgggaacggcctgggcgctgtacgacgccgcccggcacctcggcgacgccgatctggaggcccgcgcggtcgacctggctctcgccctgccggtgcgatggcccaacccggacgtgtgccacggcgtcgccggctcggccctcgcccagctgcggctgtggcggggcaccggccgcgaggaattcctcgatcgggcccggcaggccggtgaagcgttgctggccggcgccaccgaggcggacgggcgggtgtactggaccgtgcccgacaacctcgactccacgctggtcggcatcacccacctggggttcgcccacggcgtcgccggcatcggctacacgctgctcgccctcgcgcaggccaccggccgggaggacttcctgcgcaccgcggtgctggccggcgacaccctggctgtcgaggtcgaccggaaaccgtggggtgccgggtggcgctccgaccgtggcgacgagcgcggcaccggcatgcagttccactggtgcagcggctcgtccggggtgggcaccttcctgctgcgcctgtggcaggccaccggcgagatcacgtacctggacctggcccgcgaagcggccgccgcggtgcggcagacccgctggcgcacgggtacctcggcctgtcacgggctggccggcaacggcgagttcctgctggacctggcggacgcggtcggtggcgagtaccgggcctgggcgcaggaactggccacctcgatggtgctgcgccacgcccggcacggcgacctgcggctggtacccgacgagggggatcaggacgtgaccgccgacttcaacgtgggcctcgccggctcggtgggattcctgctgcgcctgcggcacggcggccggcggccgttcatggcagacccgtcgagcggacggtggcaggtcgcgccggcctcggcccgtcgtccggtggccgcacgatgagcagcccggcgacggcgcaggtcaccgcgcgcatcagcttccgcttctcggccgacgggagccgggcggtctgcatggcggccgacgaacgcggccggcaccgggtggagagctggcagctgggcaccgtcggcccccgcctgagcttcaccgcacccgtcaccggcgacccgcgctggatgatgcccctgccggtggacgccgaccgggcgctgctgacctggttcggcgccggcggggcactgaccgccgaactgctggaccgcgacggcggccgcaccacactcggcaccttcccggcaccgctgcgcgtgatcggcgcgccggcggcgaccggcttcccggcactcggctgggcggacgcaccggagagcgccggtacgacgctgcaccggctgggcgtcggcacgccgtggctgcgcccggtcgccgaggtgcccggccggctgcgcgacgccgtggcgtgcggcgaccgggtgctggtcaccaccggccacggcggccggtccacccggatgatcgtcgatccccgggacggcacgtgcgtgcccgcgccctggttggacggtctgtcccgggtgctcgcctgcgccggccgccgggtgctggcgacggtgcgccggccggagggccccaccgtggtcctggccgacctcgacaccggggagccgcggtggtcggcgccgggggactggtgccgtcccgaggtgtacccggtcgcgctcgatccgaccggcacgagcatcgccgtcgtgcagacccgcggggctcgttcgcgcctgctccgctgggacaccatgtcccgcgccgcgcaccccgtcaccatgccggacagtgatctggtgccgctcgcggcctggacgccgaacgggttgtggcttccccggtcgggcccggatcggccgtgcggcctcgcctggctaccccccggcgcggaccggctgcgggtgcccgcgccaccgtccccgccgtggtcgcccggccggctggagaccttccccggtgccggcgggccggtcgaggccgtcgtgcacgggcccgactggcgcagcgcggcacacgtcgtggtggccctgcacgggggcccggcgagccggtggtcgctcaccttcgagccgctgttccaggcgctggccacggcgggggtggccgtggtggcgcccaaccagcggggcagcaccgggtacggcaccgcccacgcccgggcgatcgtgggcgcctggggggtgcccgatctcgccgacgtcgccgccatcggcgcgttcctgggcagccgccgcgggcccggccggccgcgcccggcactgtacggcgtcagctacggcgcctacctcgcgctgctggcggccgccacccaaccggacgcctggtcggcctgcgccgccctcgcgccgttcctgtccgggccccgcctgcacgccgacggccatcccgccgtgcggggcatggtggagcggctcgacggactcaccgaggccgacgacgagatcggcccgcgcgacgtggcacggctggcgtccgggctgcgggcaccgctgctgctggtgcacggcgcccaggacgagtccaccccggtggcgcattcgcggctgctcgccgagcgactgaccgccctgggccggtcgcgtggcgtcgacctgcactacctggaaccccctgaccgcggtcacgccgtgctcggcaccgccgtccaggatccggtcaccgcagtggtgacacggttcctcgcggagagccggccgaccgtcgcccctgccccgacgagctgacgaaaggaggtgatgacgatgaccgacgatctcgacgccctgcaggacctgccggcgatggaggaggaggaggcgcaggccggcacctgccggttcacctgtgcctcgaccacgtgcaagggcacctgcccggccacctgcagcgtgaccggccagtgatcacccgacgggcggccgcgccggctggacatcggcgtggccgtcccgtcttcgaccgacttcctggaggtgcgatgcgggtcttgacggcgaccgccgggatgctgcgcgtacgcctgaccctgttcgtcgccgcgctgacggtgcaggccgcggccggcgtgaccgtgccggcgctgctcgccgcggcgagcgacgcggtgctagctagctagccgtcgccatcggcgcggtcggcaccgcgcgtctgcgcatgctgaccctccggcggctgctggcactcgggccccggtcgccgttcgccgtgggggaggcggtgacccaggtggcgcaggccgccccgcaggccgcggcgctccccggtcatgtggccgaggcgtccgtctcagtcgccggctcggccgcggcactcgtcgcgttgtggctcgtcgactggcgggccggcctggccttcaccctcctggtgccggtcaccgtgctggccgcccggcggttcgtcaccgaggccgccgaggtcgagggccgctatctggcggcacagacccgcatggcgtcgctgttggccggcgccctcaccggtgcccgcaccatccgggccgccggcaccctggccgccgagacccgtcgcgtcgccggcccgctgcacgaactgtccgccgcgggccacgcgtcgtggcgcgtccagcgcagcgccgtctggaagatcgggttgctggtgcccggtaccgagatcgtcgtgctggccgtcgccggagtggacgtgagcgccgggctcatcaccgccggaaacctgctcgccgtcgccggctacctcgcgctcgccaccggacttctcgaccagatcgacaccgcgctgagcctggcgcaggcccgcgcgggcgccgaccggctcgacgccgtgctgcagcggccggccgtcccgggcgggccccgcagcatcccacccccggacggcgcggtgtcgctgcgcggcgtcaccgtcgtgcgcgccggcgggcgggtgctcgaccggctcgacctggagatcccggacggtgtggcggtggcgctggtcggcgccagcggctccggcaagagcgtgctgggcgccctgctcggccggctggccgacccggacgagggtgcggtccacatcggcggcgtcgacatcaccgacctggatctgccggccctgcgccggacggtgacctatgccttcgcgcgccccgcgctggccgggcgcaccctgcacgaggcgatccggctcggccggcccgagctcgaccgggtggcggtggagtcggcggcccgcgccgcgcggatccaccacgtcatccggcggctgcccgccggctacgactcggtgcccgcgcgtaccccgatgtccggtggacagctgcagcgtgtcggactcgcccgggccctggtgcgacccgccctggtgcacgtgctcgacgacgcgacgtccggtctggacagcgtcaccgagcgggaggtcagcgaggccgtgacggcccggctgcacggccgcacccgcgtcgtcgtcacccaccgcgcggacaccgcggcctgctgcgacctggtcgcctggctggacgcgggacgggtccgcgccctcgcgccgcacgccaggctgtgggccgatccccgctaccgggccgtgttcgagaccgtggcggtcccgtcggcggccaccgaccgggagcagccgtgcgccgccgaccggtgagcacccggatgatccgcttcggcctgaccgggccggccgccgccctgctcggcgatgtcctgcggggcagcggccggccgctgcggcggatcgccgtgctctcggtggccgaggccgctcccgcactggcatccggctgggtcaccgcggccgcgctggaccgtggcttcctgcagcaccggctgtccgtcggactcgcctggctcgccgtgctcgccggtctgcacctgctgcgggccgccgctgaacgtgccctgttcgatcctctggccgcggtcgtcgagccgatgcgggaccggttgacccgccgggtggtgcaccacacgctgctcgaggcgacctcgctcgcggcgccgccggacaccgccggggtgtcccggctgaccagccaggtggacgcggtacgggacctcacctcggcgctgctgcgcaccgcccggcccctggccatcacgctgctcgccgcgggagccggcctgaccgcgctcgaccccgtgctgtccgggccggtgctggcggcgctcaccgtcgccctggtggccttcgcgtggtcgatccggcgggtgggggcgctgcggcgggtcgcggtgctggccgccgaggacgtcgccgcccgggtcggcgaggtgctgaccgcggcgcgggacatcaccgcgctgggcgccgaggaggaagcggccgccctcgtcgaggcggactcgcagcgcgcgctgcgcgccatgctgagcgccggtcgcgccgccgcgtcccgggtaccggtcgtgctcgtgggtggccatctaccgctcgtcgggctgctgctggccgccccgcacctgatcggcacgcgggccatcaccgcgggcaccctcatcggggccgccacctacctggccgggtcgatcgtgccggcgctgcggatgttgaccagcgccgtcggcggttactggaacaccctcgccctgctgctgcaccggctggccgaggtggccccggatccggtcgccgatccggtgcccccggccccggtgtcaccggcggtgcgtcacgacacgaccgccgacctcaccgtggcggggctcaccttcgcgtacgccgccgacgcggagccggtcctgcgcgacctgacgctcaccgtgccgtacggcgatcacctggccatcaccggcgccagcgggatcggcaagtccaccctggccctgctgctggccggcatccggcagccgtcggccggtcaggtgcgcatcggcggtcgtccggccgccggactgcccgaggagcagcggcaccggctcgtcgccctggtgccccaggaggcgtacgtcttccccggctcggtgcgggacaacctgcgctacctggccccgtccgcggacgacgacgaggtcgttcgcgcggtggcggcggtcggcatgaccacgctgctgggccggctcggtggcctcgacgccgagctgaacgacccggccgccaccctgtccgacggcgagcggcagctgatcgcgctggcccgcacgtacctgtcgccggcgccggtggtcatcctcgacgaggccaccgcgcacctggatccggccgcggagacggtggcggaggccgcgttccgcgaccggcccggcaccctgatcgtcatcgcgcaccgcaccggctcggccgcgcgggcccgacgcgtcctgcacctggacggcgacgaccacacggtgaccgagcacctcggcgcacacacctgaggtcgagccgcggatccgcccggtcaccgggcgaacaggaatgtcaccagcagcaggaccggcacgcaggccagggtggtgagcagaatgacgtcccgggcgagaaccgtgccggtggcgaaccgctggccgtacaggtacacgttctgcgcggtcggcagcccggccagcaccgtgacggcgtacgcctggtcgtgcggcaaccgcaacccggccgccagcccgcaggcggccagcggcatccccaccgttttgagcccggccgcgaccagcgtggcccggcggtccgggccgggcgcgagaatccggcggccggacagcgacatgccgaacgcgatcaggaccatcggcacggcggcatggccgatcgtggtcaccgggtccaggagcacggcgggcagccgcaggccggtcgccccggtcgcggcgccgagcagggtggccacgatcagcgggttgcgcagcggcgcggtcaccgtgccccgccacgatgcccggccggtggtggcgatctccagcagggtgagcgcgaccggcgtgatgaccagcagctggagcatgatgatcgggacggccagggcggcgtcgccgagaacataggtggcgatcgggatcccgatgaagttggcgttcacgtaaccggcggccagcgcgcccaccaccggcgaacgaccgcgacagatcagcgcgaacagcccgaagcacaccaccgccgccccggccgacaccagcagcggctcgctgaacagcgccgccgggtcggccgcggccaccccggtgaacagcaggcacgggttgagcaccagccagaccacccgggccagcaccgcctcggcgtccggcggcagccggccccaccggcgcagtccccacccggccagcacgatgacgccgatcagcaggaaaccggagagcgcgtgggccatgatcggccacgctatcggccggtgtcgccgatcgtcagcgggccggctgcggtgaagccggcgacggtgcgggccgcgtgccgcagcatcgtgcggaccaccagcgggtgcacccggcggacgacggcgagataggcgcgtccggcgcgggaccgggtcgccgccagggtggccaccgtgacggtcgtgccgtcggcgtccggttcgacccggagtgcggcgcggaaggcgaggtggtcggcgtcggtgccgagcagcacctcccgatcggtgcgggtgagcgtgtcgaaggccgaaccgtcgtccggcgcgatgccgaccagggtgaccagccggttccgcagacgcagcagcgccgccacgactctcggcggattccggaagaccgcgtccgcccagtcctgtgggtcgacggtggtgccgggcggcacgcgcaccgcgaaggcgtcggccaggtcgggccgcgggaccgagccgggcagcaggccggcgtggggcaccggcgcgacccggacccgggcgccggtcgcggcgagcgccagccgggcccgccacgggtaccgcaccgggtgcgtgacggtgccggtgaccgcccgctcggcgttgtccagcaggtgctcgaggacggtgtcgtggcaggcccggacgacggccggccagagcagccgcatccggccgatcggcgtgccggtcagccggtgccgcagcacgcagccgtgtggcccgtgatcctcgacctccagagtgtgggtgccgatcaggccggtgcccgggtggaaggtcagctcgacgcgccggcccggttcgtacccggtgacgtggtagcggatcgggccgtgcccgccgtcggcgccgacgccgagcggccggtcgaaccgcatcggcgcccagggtggtgcgggccagagtgggtcgccgggggcgcccatccggtccagcagccggcccacccgggctgccgggacgggtagagcccgttcgtggacgttgtgcacggtcgctgccatggtctgcctccgtacggtgccgtatggtttacatacgctagcgtacggtcatgcgggagcaacaggagcggcgcggcaccggcaagcgggcggcgtcccggctgacagcggacgactggaccgccgcggccctggaggcgatggccgccggcggcctcggggcggtcgcggtggagccgttggccgcccggctgggcgccaccaaggggagtttctactggcatttcgccaatcgggaggcgctgatcgaggcggccgtgctgcgctgggaacgggagtacaccgagggcgtgatccggcacgtcgacgccgagcccgacccgctggcccggctccggctgctcatcggcctggtcctgggggccaccgcgccggaccggggcggcgccgtcgaactggcgatgctcgccaccgccgaccatccgcacctcgccccggtgctcgcccgggtcaccgagcggcgggtggcgtacacctcggcgttgttcaccgcgctcggctggccggtcgccgaggcgcgccggcgcggagtgctcgcggtcaccgcctatctcggctacgcccagatggcccacgtcgcgccggagtccctgccggccaccgagccggagcgactccgctacgtcgaccaggtcgtggacctgctcaccgcgcctagtagaccagtcgtctagagtggggctgtggccgacccgggccacggagtcgaagggctgaacatgaacgttctggtagttctgacctcgcacgacgaactgggcgacaccggccgcaagaccggcttctggctggaggagctcgccgcgccgtactaccggctccagcaggccggtgccacgatcacgctggcgtcgccgaagggcgggcgcccgccgctggatcccaagagcgacgagccgggctcgcagaccgaggacacccgccggttcgcggcggacccggcggcgacggccgcgctggcctccaccgtgccgctgagcacggtcgatccggccgactacgacgcggtgttctacccgggcgggcacggcccgctgtgggacctggccgaggacagccactcccgacgcatcatcgagaccacgctgcgctccggcaggccggtcgccctggtctgccacgcgccgggcgtgctgcgccacgtcaccgacgaggcgggcgcgccgctcgtgcggggccgtcaggtgaccggcttcgccaacaccgaggaggccggcgtcggcctgaccgaggtcgtgccgttcctggtggaggacatgctcaaggccaacggcggcgtctactcccagggtccggactgggcctcccacgtggtgcgcgacggcctgctgatcaccggtcagaacccggcctcgtcggcggaggccgccgatgtgctgctcgcgctcctcgacgagcgcgccaccgcctgacccaccggtcccttcggcacataggctggcgtggtgacgaccaggaatctccaccgcgacacgcgtacgcagctgctgctggctgccgagcggtcgttcgcccgcaagggctatgccgcggtcggcatcaacgaggtcctgtccagcgccggcgtgccgaagggctccttctaccactacttcgcctcgaaggacgcgttcggcgaggcggtgctcgcacgttacttcgagcagtacctggcggagatggacgagatcctgaacgccgccggtcgagacggggcttccaagatcctggcctacttcgcgtcctggcgggaatcgcagagtctcggtgactgtgcgggcaagtgcctggcggtcaagctcggcgccgaggtcgcggacatgtccgagcccatgcggctggccctgaaagccgggaccacggggatcgtcgaccggctcgaacacgcgatcgtcggcgccgtcgccgacggatccgcgccgttcaccggggatgcccgcgccaccgccgacgcgctctatcagctgtggctgggagccagcgtcatggccaaggtgaaccggagcccggccgccctggacaccgcgacgacggtgacccgccggctgctcggcatctgacggcgcggcccggcgcaccggatcaccacctcgatcgtctggccgtcttggaagatgccctcgctgccatgttcgggcgcgaattacccagaaggtcaacatttcatagaactcgcctgtaggtccttaccggcaccgaccgcctcattcgagttgcctgctgtgaagcggaccacgacgcccacctcgcgccgttctccaccgcgattcgctcgctgcactgcgttatggccgccggggcccaccgctcccgctcgcgccgatgaacgggtgccgggaagcaccggactgatggactgggtccgcaatagggtgcctggggatgaccgccttaccggccaccagattctcgagcagccgaggaccgcactcggcgtttggcctcggtccagccgacggcccgccggtcaaacgcggccaacgcggggagcgacgctggtcggtgcggtaccggagaccgccgatcgggttgctggccgagtgcggcatggcacagccggtatcggttgccaccgccgtcgccgacgttgcactcctcagcaatcagtaggccggcgctgcgaagctgccgtagcgcggtggcgatgctggagcgcgtagcgggagggcggcaacgtgcccccccgcggctctcgcaccgatttcggcatgcgacagacggaccgtgccgtcgtcgattgcgttgtcgaccaggcagcgccggacgtcacggcgcagcccattcacagcgctggccgtctcgatgatcccggacggggatccgcgacgcggcgccggcaggcccggcgcccgcgtcgagaccgcgatgccgcacctggtcaggcgctgtccgggaccgcgaaggccgcctccagcggcggaaacgccttccgggcgtccaccccggcgaaccagaggccgaccaccaggacggacgtcgcctccagatatcgggcgcggtgcagcccaccggccggagccggctgcgaccccaggtcactgaccagcaacccgaccagcttcaccgcgtcgtcgtcgccgcacagcgggacgatcggctgctgcccggagagccacacctcagccgcgcacagattgaaggccttcaccacgtgcgtaccgggtgccgccgccgcgatccgttcggccaccgcgtcctcggcgagcaccagcgtctcgcccgccgcaccgtccggggtgaacgcattggtgcaatcgatcagcgtacggccggaccacgcgccgtcgcccgcctccgcgagcacctcggacagcgcggccaccggaaccgcgagcaggacgacctccccgaaccgcgcggcgtcacggacggtgccggcgcgggcaccgtacccgatcgctgtggccagttcgtcggcccgctgcggcgatcgcgcgccgatcatgatctcgtgcccagccgcggcccacccgccgccgagtgcccgcgccatctgtcctgcgccgatgatgccgattcgcatgcttgctccttgaccgtaggtgtcggtgccgacggtagggacgccgatgcgcacccccaggtgcgcttcgcaggtggcacgctcaatgacatgacgacgagcatcgaacggacggtcttcccgtcgtacggagactttgaatcggattgtccggcgcggctggcggtcgacctgttcggcaactcgtggctgaccgtcatcgtctacacgctgcgggacggtccgatgcggccgggcgcgctgcggcgggtgatcggcggcatcagtcagaagatgctcacccagaccctgcgccggatgcagcagatggacctggtggagcggcgcagtttcgcgcaggcaccgccccgggtggagtaccgactgaccgaggccggccgggacctgctcgttccgatcctcgccctgggcgcctgggtcgatcggcacggcgacgccgtccgcaccgcgatgctcggttccctcgacgagtcgtgacccggccgtcggcttccctggtcgagtcggccatggcctcggggtgagggccggcgtgcatgacgatgaagcggtggtgacggcctgctcgccccacctcatgctggtggcgtctaccagggctgataccgcttgccggcgttcggatcggcgtcaccgtgacgccgatccgaacgccgggaacggagcccgtgcgaaacaggcggagagacagccactaacgcttcgtccagccggtcgagcaccagaaaaagatcatcgggcggtgttgcagcggcctccgcgtcagacatgtaagggtgtccgacgcgagaggggaactcatggcgatggtgagcgagctcgacttcaccgagctctaccaggcgcactacgtggacgtgctgcggttcgtccgacgccgggcgagcccggaggacgccgacgacatcgtcggcgaaaccttcctcaccgcgtggcgccggcgcgcggacctgccgcccgagccgcgcccgtggctgttccggaccgcccgcaacatcatgctcaacacccagcggggctcccggcggcagcaggcgatcagcatccgtatcgcccatgagccggcggaacctgtggccgacgccatggggccggtggagacccgggtcgacctcagcgccgcctggcgggagttgaccccccgtgaccaggagacgctggctctgcacatctgggaggcgctcagcgatcgggacgcggctgccgtcctcggctgtacgagagcgacgtacaccatgcgactgatgcgggcccggcgccggctggcccgcctactcggaccgggggccgtcgtctcgtccgccgccacccccgccccgcacccgacgtccacgctggcaccgaccggatgggagcactcgtgaacaccgacaccatcgccctgctgaagtctcgcgacggtgctccggcccgcgccctcacccgggaggagaaggcccggcaggcgcatctgctgcaccgcatcctcacggatccggcgcccgttcgtccggcggctgcccggtcccgctcctgggcggcgttctggacgaccgccggcatcggggccgtggcgatggccgccgtcgccgtcgtcgtgaccgtcggcccaggggtgctgcggtctccggccgcaacggggctgaccacggtcgacgtggcgagctggaccagcacctcgatgcgcctgccgtccgcggcccaggaggtcgccgcgggtccacgggactggtgcatgaagaacacggtcggtgatccgaacagcacggcgacacgcaccgtggtcagtgctgagcttcgcggggtggtcggctccctcatcatgaagcagggcgacgactactcactgtgtatggcgggacgggaccgatcgggcttcgccgagctcctcgacgcacccacaccgctgctcgacgcagaggtccggccgatgaccggcggcggccacggcgacgggaagtccgccttctcctacgtggtcgggcgggccggtgatgcggtgacgagggtgaccttgaccgtgggcgcgaggacggtcgacgcccacatcgaagccggctggtggacggcgtggtggccgaaccccgaagccaccggcgaccggcccgagcccgaggtcaccgtcaccgtcaccgtcaccctccgcgacgggcgcagtcgcaccgctccgctgtcctacgatcagccctcggccggcccccagccgtccgccacggcgtcgcgctgatcccggcagatgccgccgcacctcccggggtcaacagtggtcgtcgaggagtacgcgcggtgacgccgcggcgcggcgcagggcgtacagggtgagggcggccgccgccaccagcggcgccccgtcgcggatcagtccgtcggtgcccagcaggaggcggcacagcggcaggtcgaacagcagcaccgcgatggtgaccgacaccagggtccggcgggcccggccgctgccccgggcgaggaggaaggcggacagcagggcgacgtagctgaccgcgatcccggccaggatccacaggatgaccgggaacgcccactccggacggtgccccagcgtgcccgccgcgaccagggccggcaccagcatcagcgggctgtaactgaacgcggccagccgggcggtcagcacccacgggtcgcccggcggggcctcgcgcaggctcaggccctcccgggtcaggaccggccggcgcggcaggtgggtcaggtgcgcgccgatgccccggtggcggtgcagcagtgcgaccacggtcagccagagcatggcgagcacgccgaaaccgaccagcccggacggcgagacgatcagccggccgaccgcgaacagggtggtcatggccaggatgacgctcagcggcctggcggtggcccggcccttgcggacctgggagatcaggatcagccagcccaacgtgcggaccagggcccaaccggtccggaccgcgaatccgacgccgtgctccggggcggaggagaagttgacggtctcgacggcgacggtggcgacggccgtggcgatcaggagtccggtgagcacgcggaccgggcggggggtcatggtgacgccttaccccggacggcgggtgagaatggctcggtgagcgatcccgatgcgtattacctgccggccggtgacggcgagttcgacgccaccacggcgacgaccagtccgtgggacgacgcgatgcagcacggcggcccgccggccgggctgctggcccgcgccgtcgagctgacccggcccgatccggagatgccgatcgcccggctgaccgtcgacatgctcgggccgatcccgcgcgggcgggtgcgcaccgaggcgacgatcgtgcgcccggggcggcgggtggagatggtcgaggcgcggctctgggccggcggcagactcgcggtcaccgccacggcgtggcggatcaggacgcagaaggaccttacccggcggtacgccgtaccggtcgtaccgccgcctcttcccgccgcgcaggccgcggtcttcttccccggtgtggaccccgcgtggggttacggccgctcgatcgagtggcgtttcgtcgccggctcgttcgccgaacccggtccggtcgagttgtgggcgcgggtccggctgccgctggtggcgggggagacgccgtcgccggtgcagcgcctggccgtgctcgccgactcggcgaacggcatctccggggagctgccgctgaccggatggctgttcatcccgcccacgatgacgctgacgatcgcccgggtgccggagggcgactgggtgcatttcgcggcgcggaccacgatcggcccgtccggcaccgggatcgcccagggggtgctgtccgacccggacggattcgtcgcccaggtcggacaaccactgttgatcagcccgcgatgaaggtcggtcggcggtaaagggtcagcccggcgggacaggaccggaaagggtcagcccggcgggaaagggttgtaacgggtcagcccgcggtggtcactccgcagaccgtgccgttcagggtgaacaccccgggcggcacgttcggcccgctgtacgccccgacgaaccccacgttcccgctcgccccggcgcccagggtcgcgtcgctggtgacccggacggtccgcccgtccgagttccaggtggcaccccacccgctgctcacgctctgccacccggtcggccaggtgaaggccagcgtccagccgctgaccggcccggccccgttgttggtgacgtcgatcgaagcgacgaacccgttgccccagtcgttggtgtcgcggtaggccaccgtgcacgcggcgtcggtgggcgcgccggtcgtgacggtcaccggcggcgagggcggggagagccgcccggcgccgtcgcgtgccagcacgttgatcgtgtaccggtgcccgggctccaggttgtgcaccgtgagcgaggtgccggtggtctcgcccagcagtgcactgacgccccggttctgccggtacacctcgtacttcaggccgccgccgccggccggccaggagatcgtcgcggtgcggtcggtcgcggtcgcggccggttgtccgggcgccttcggcgccttcgggtcgacccggtcgggatgcaggacaaccagatcgacggtgtacggcgcgagcacctgcgtgcccgctgtcccggccgcgccactggtcacccgggtcgccccggtggcgtacgtggacaccgtcggcaccgccgcggacggcgtgaagccctggtagttcagggccaccgtgtgcgccgcgtccgggtccttgttgatcagcaggaccgccaggtcgccgttggcccggtgcaccgcgtgcgcgctgaccagtgcgttgtcgctggcggtcccgacgaagcggtcaccggcgtgcgcgagcgagccgaccagcgacagcgcgtggtatgcggggaacggcgtgttcagcggcggctcgcaggccgcgttgtccggcgtgcaggtgccgctggagagcagcccgaagtcgttgaagtcggtctgcccggcgatcgtgcccgcccggtccggcccgttgtggacgttccaccagtccaccgtgaagacgccctgggcgagcagcccgctgtagacgtcggccaggaacagcgcccccggctgggtgttgcgcccggcgtcgacgttggtctcggtcatgctgatcccgatccgggagctgtccgccccggcgtaccggctgatctgccggcgcagcaggtagaccgcgtcctggatctgcgccggcttgcccagcgcctcggccggggtggtcccgcccgggtaccagtgcacgtcgacgaagtcgatggcggtcccggcccgggtcagcacctcctggttccaggtgccgctgtcaccggccccgacgatcccgtccggccagttccccggcatggtcagcaccgcaccgaccttgacggtggggtcgacggccttcatcgcctgggcgtaggcgaccacggcgtcggcgtactccttcgggctcttgtcggcgtggtcgtccgcctcccacgccgagccgtagtgcccgttgccgtagttctcgttgccgatcgtccagtaggtggcgtggtagcccttggtgacgttcgcgtaccggacccagtcggccgcctcctgcgcggtcccggtgccgtagttcgcgatgatcattggttgggccccggtccgctgggcgcccgccatgaaggtgtcgaagtcggtgccgggcgcgacgtagccgccgggtgccgtgttgtccttccagtggtagatgtcggcgtacgagccgccgggataccgcagcatcccgacacccgcgtcgtgcagcaggtcggcgaccgcgtcggtgccgagctgggagtcccagacggcatggttgacgccgaccgcggtgccggccacggtggcgaggccggcccgggtgtcgacgtcgacgtgggtgtcagcggtcgccgcggcggccggtgtcggcgcgatggcgggcgcgagcccgatcgtcagcagtacggcgcttgcggcaacacgccgtcggatccaagggtgcacggggctctccaggggacgagatgatgggagcgctcccataattcgccgtggaaatcaactctgtcaatgaggacggagcggtggcccggccgcgcgcgggcggcgcggggcggtgcgggaggatgccggttgtgggcatgacgagcggtgagggccggggagcacaactgttgccggtgctcgggcagctggtgcggttcctgcggcagctggaggggccggacaatccgagttcgatcgcgctcgccgtgctgcgccgcctcgccgatcacgggccggggcgggtcaccgacctggcgcggctcacccgggcctcacagccgggcatgacccagctgatcgggcggatggagaaggccggacaggtgcgccgggtgcccgacccgcacgacgggcgcggcgtgctggtcgaggtgaccgacgccgggcgtgagctgctcagccgcacctacgcgtattacgccaccaccctggaccggctcttcgagcagctgaccccggaggagagtgacaccgtggtggcggcgctgccggccctggaacgcctggcccgggccggtgagcgggaaagcgccggcacccggtagggtcggcgctgacaagtgaagactttcgccgtcacagccgccgcgggagagtcccagggtccgtcacctgggcgccgaaggagcaaattctccctcagaatctctcaggcacccggtaccgcagcggtcaggcgactctggaaagtcagccccgtcgcgggctgcgcccacggtgcaagccgccttcgcggtgaacctctcaggcacagatgacagagcgagggaggcccgacacccgaaggagcctccctgttgcgacgcaccgcgctgcacgacgtccaccgccgcctcggcgcctcgatgaccggtttcgccggctgggagatgccgctgcggtacggcagtgacgtggccgagcaccacgccgtacggcaatcctgcggtcttttcgatctgggccacatggggcagatcgcggtcagcggaccggatgccgccgccttcctcgatttcgccctggtcgggcgcctctccgcggtcgccgtggggcgggcgaaatacaccatgctgtgccacaccaccggcggggtgctcgacgacctggtggtgtaccggctcgccgagcgcagcttcctggtggtggcgaacgccgcgaacgcgccgatggtgctcgccatgctcggtgagcactccggcggcttcgcggtgaccgtgaccgagcacgtgggtgcgctgatcgcgatccaggggccggacgccgtgaagatcgtcggcgagcatcccgacctgcggtattacgcgatcaagccggagcgggtggccggccgtgacgtgctgctggcccgcaccgggtacaccggcgaggacggcttcgagatctactgcgcgaacgaggacgccgaggcgatctgggcgtgggcggccgccgcgggcgcccagccggccgggctggcctgccgggacacgctgcgcctggaggccggcatgccgctgtacggccacgagctgaccgtgcgcaccacgccgttcgacgcgggcctggggcgggtggtggcacgggacaagcgggatttcgtcggcggcgacgcgctgcgggccgcggagccggtgcgcgagctggtcggcctggtgacgaccggccgccgctcgccgcgcgcgggctatgcggtgatcgatgcggagaccggggcgaaggtcggcgaggtgaccagcggtgcgctgtccccgacgctcggccaccccatcgcgctcgcctatctccggaaaaatctggatcgggcccggctggcggtcgatgtacggggcacgccgatcccggcggagatcgtgaagctgccgttctaccggcgaaagaaggactgatggccgtctcggtgttcgacctgttctcgatcggcatcggcccgtccagctcgcacacggtcggcccgatgcgcgccgcccggatgttcctgggacacctcgacgaccgggtggcgaccgtgcgcgccgagctgttcggctcgctgggcgccaccgggcacgggcacggcaccccccgcgcggtgctgctcggcctgatgggcgaggacccggagacggtcgacaccacgctggagccgccggcctccctcaccatggacgaccgccgggtcgaggtcgacctggtcctgcaccggcggcggtcgctgcccgagcacccgaacgggatgacgttcaccgcgctcgacgcgagcggcgcggtgctgatcagcaagacctacttctcggtcggcggcgggttcgtcgtcgaccagggcacctcgcggctgcgcgccgacgagaccccgctgccgcacccgttcagctccggcgccgaactgctcgcgctcacccagcgcaccgggctgtccatctcccggctgatgctggccaacgagaccgcgtggcgccccgagtccgaggtgcggtccggcctgctcgccatctgggacgtgatgcgcgactgcgtcggcgccggcctggacgccgagggggtgctgcccggcgggctgaaggtgcgccgccgggccgccgccacggcccggcaactgcgggccgccggggatcccgcggtgcacgcgatggagtggctcaccgcgtacgccatggccgtcaatgagcagaacgcggccggtggccgcgtggtgaccgcgcccaccaacggcgccgcggggatcatcccggcggtgctgagctactacacggcgttcatcccgggcgccggcccggacggcatcgtccggttcctgctggcggccggcgcgatcggcctgctgttcaaggagaacgcgtcgatctccggcgccgaggtcggctgccagggcgaggtcggctcggcctgcgcgatggcggcggccggcctggccgaggtgctcggtggcaccccggagcaggtggagaacgccgccgagatcggcatggaacacaacctggggctgacctgcgacccggtcggcggcctggtgcagatcccgtgcatcgaacgcaacgggatggccgcggtcaaggcggtgaccgcggcccggatggcgctgcgcggcgacggtaggcaccatgtctccctcgacaaggtgatcaagacgatgaaggagaccggcgccgacatgaagatcaagtacaaggagaccagccgcggcggcctggccgtcaacgtcatcgagtgctgagcaccccgtcgaactcgaacaccggtttcggcacgtcgtgtccctgcgtgtcggtgaccgtcgcgagtccgatgatcttcgacgggccaccggccacgtaggtgccgtcggtcttcacggtgacctcgaacttgccgtcctgatgctgcccgtgcaggtcggtgaagctcatcatgcagatccagttcgggccggcgccggtgtcggcgaccttcggtccgcccttgtcgcaggcggccgaggcgccgatcgtcgcggtggtcacgccgggacggcgagcaccagggcggcgcgggtgatggcgggtcgcatggtcatcctccggtgatgtcgcggcggcgcagcgtcaggaacgccgcggtcaggcagatcagggtccgggcggcactgaccgccagcccggcggtcagcggcccggtgaacggacggcgtctccccggtgggtcgggccgcgccgcgcgatcccgcgcccacgaccgcggcgatcagggcatcgatgcgctcctgcggaccgcgcaccggcagcccgccgccatcgatcggcgccacgtcccgcccgctcacggcggcgattgcggcggtacgctcgtcgtccccgtccggatctcgtgcgcctgctccggggcccgctcgcgcagcgccgcgatcgacccgtggtggccgaccgcgtcgaccgccagcacgtcgctcatgccgggaaagttaaagatccggcatgaaagcgagatgaaggcacgcctatcctcgctgcgaaccaccagccgccgacccgggagattccgatggacgaaacgccgaccgacctcgacgcactgcacgagatcgcccggcgcgtgctgtggctgtcggcgtcgatcgtcgacgccgccaacgccggccggcccaacgactccggggtcaaggtcggcggccaccaggcgtcgagcgcctcgatggtcgacatcatggtggccctgtggttcgccgagctgaccagccgggaccgggtgtcggtcaaaccgcacgcctcgccggtgctgcacgccgtcaactggctgctcggcgacctcgacgaggcgtacctgccgacgctgagggccaagggcggcctgcagtcgtatccgtcccgcctcaaggacccggacacggtcgacttctccaccgggtcggtgggcatcggggcgacggcggcgctctgggccgcgatggcgcatcggtacgtcgcctcgcagttccccggcacggcccccggtggacgcttcatcagcctgctcggcgacgccgaactggacgagggcgccatctgggaagcggtcatggacccggccgtggccaagatgggcgagttgctctgggtggtcgacctcaaccggcagtccctggaccgggtcgttccggacatccagatcaccaagttgcagggcatgttcgcggccgccgggtggcaggtcgtcatcctcaagtggggtcgcatcatctcccggctgttcgaccggcccggcggtcagtcgctgcgcgcccggctggaagcgatgcccaacgaggagtaccagcggatgctgcgggtcggccccgccgaggtggccgagcgcatcctggcgggcagctcatcgctggccgacggccacgagctcaaggcgctgctggacgagatcccgccggacgagctcgccgccgcggtccgcgacctcggcggccacgatctgggactgctcgtcgacaccttccacggcgtcgagacgcaccgccccaccgtcgtgttcgcctacaccgtcaagggccgcggcctgcccaccgaggggcaccccaacaaccactcggcgctgctcagcgccgcccagatggacgcgctggcgcaggcctgcggcatggaccgccgggcgccctggcagcgtttcggcccggacaccccggccggccggctgtgcgcggcccgcggccgggcgctgcgccgcgagcccgtcgcgccgacctcacccctgccggtgccggtccagctcgaccacggctaccgcaagccgatgagcacccaggcggctctcggccggttgctggccgacctgccgcgcgacgctcccgaggcggcggcccgggtggtcacctgctctcccgacgtggcgtcgtccaccaacctgggcggctggatcaacaagaccggcgtctggtcggtggaggaccggcacgactggttcgccgacgacgccgagcgggtcctgcgctggcgggaggacagcaacggtcagcacatcgaactgggcatcgccgaggtcaacctggtgtccctgctgggcgagctgggcaccacctggtcccgctggggtgagcggctgatcccgatcgccacgctgtatgaccccttcgtgtcgcgcgccctggagccgtggtcctacggcatctacgccgggggtcagtccatcctcgtgggcaccccgtccggcgtgacgctcgcgcccgagggcggcgcccaccagtcgatcaccaccccgtcgatcgggctggagcagcccggctgcgtcgcgtgggagccggcgttcgcgcaggacctgcagtggtgcttcctgcacgcgatgagccgggtcggcgtcgagggcggcacctcggcgtacttccggctgtccacccggcccatcgatcccgggctggcccgcgtcccggaggaccccaccctccgggagcgccgtcgccggcagagcgtcgccggcggctaccggttgccggccgatcacccgatcggcgacgaggaggtgacgctggtcggggtcggcgccatcatgcccgaggtcgtcgcggccgccgacgctctggccgcgcacggcgtcaaggccggggtcgtctgcctgaccagcccggatctggtcttccgctcgttccagcagcgcggcagccgcgctgccggcgtgggcggcggcatcctggacgagctgttccccgccgagcaccccacgcccctggtcaccgtgcaggacggccatccgcacacactggccttcctcggcgcggcgcgcggggaccggatgcgttgcctcggggtgaccgagttcggccagtcctccggcctggcggacgcctaccgcctgcacggtatcgacaccggcagcatcgtcgacgcggcgctgaccctgacccggcactgacctcgcggtcaaccggttcggcggagctcggcggccctctggcgaggggtcggccgctgctccgcccgaccggtggccggcatgtgcccccggtcgtggcgggcgccggagcgggatctcctcgacccggccgcaaatgcgggccgtcatcaccgccggtcgcctcgaccaggccgggccgggctgcgctcgtcccgcaggcagacaaggagccgcgcgggccggctgaccgtcgctccgggccgttttcgcgcgccgttgctctcaaggcggctgtcgccgtgccgataagggcacgtccaccgcgtgcggggtggggtgttcaggcagcgacgggagttggggaccgtgttccggggcgaccaggtgccgaagcgcgtcagggtgtgcgacgcgggcgatggtgggttcaccatgctcgagatgatcgtgtccgccgcggtcgtgtgcgtcgtgctgatggggttgagcaccttcttcgtgcaggccatgtcgacctcgcacgggcagggtcagcaacagggcggcatccggctcgccgcggatgccatggacaccctccgggcgccgcaggtgacggccctgctgtccgagcgtgcgccgtgcgccacggcatgcccggcgccggtggccaaggcggtgccgctgctggccgacaccgagcggtgggacgccgcggcggtgccgacggcggtcaccaccgcgccgtccacggccaccggcggcatcgccttcccggtgccgccgagctcgtcgggcatcgcggtcaacggggtgacgtaccagcgctatctctacctcggcaagtgctgggagcagaccggcgggagtccctgcaccgccgacaacacccagccgatcgccatggtgcgcgcggtcgtcggggtggcctggccgtcgcccgcctgcggcggcgacacctgctcgttcgccacgtccacgctcttcggtgccggtgggtcgggcgacccggtgttcggctccggcgcggtggccgtgaccgccgtgcccgaccaggtcagcacgctcgggtcggcgatcgcggcgctcccgctgtcggccaccggcggcagccggccgtacacctggtcggtcaccggtctgccgaacggtctgaccttcgacccgaccacgacctcggtgaccgggacgcccacgagcgccggcacctcgacggtgacggtgaccgtcatcgacgcccgcggcaagaccgcccggatcaccttccggtgggcggtcgtcaccaagatcacgcttgccaagatcgctgaccagggcaccacgcagggtcgcagcgtcacgctctcaccgtccgcggccggcggcaccactccgtacacgtggtcggcgaccggtctgccgaacggcctgtccatcgacagcgccacgggggtgatcacgggtacgccggacaccctcggcgcctcgaacgtcaccgtcaccgtgaccgacgcccgcaagcagaacgccaaggtgtcgttcgtgtggacgatctactcggcgccgaagctggccattccccccaagcaggacacctacatcgacaccgccgcggtcccgctgcagatggtcgccaccgacggtgtcggcccctacacctggacggccacgagtctgcgcgccggcatgtcgatcgggtcgagcagcggcctgatcaccgggacgcccgccgccctgggtaccgcccacgtcgtggtgaccgtcaccgacagccgcggcgagagcgcctcggtgaccttcgactggtccatcgacaaggctcagcagctgaacgacagcaccaccacccagctgatcgtggccaacccctcgctgtacacctggggtgccgtcaacctgccgccggggctctcgatcaactcggcgaccggactcgtgagcggcacgccgaccacggccggcacctgggacatccagatcctgctcaccgatgccagcggcaccgtgaagaagatccccttcaagtggacgatctacgcaccgctgaccatcacgtcgccgggcgcgcagtccagtcagaagggcaaggcgatcacggcgctgcagctgacccagacgggcggcgtcggaccgttcacgtggacggcctccgggctgccggccggcctcgcgctggacgcgaacaccggtgtgatcaccggcaagccgatgaccgtcgccacctcgaccgtgtccatcaccgtgaccgacttcgccggcaaccggaagacgatcgcctttacctggcaggtgagctgatgaggaaccggaccccgatccgggcacgccgcgccctgccgggcggggacgccggggtcacgatgatcgacctgatggtcgccatggcgctgatgtcgatcatcggggccatcgcgaccggcggcctggcgcagctgtaccggatgaccgacgccaccgaccggatggacgaggcccagacacaggcgagcctggcatacgccggcctgcaaccggagatcggcgtcgcctacgacatcagtgacccgggcgccggagccggcggcgatccctccgtcgagtacgtcacccaggattccagcggtcagcgggtctgccaccagcttcgcctctccggcggaacgctgaagctgcgccagtggcccgcgtcggccacgaccgtgtccgcggccggctggcgggtcctcgcgtccgggctggcggctcccgccacgccggacgccgacaccggcgcggcggccgcgccgcagaccctgcacttccccgacttctcgacaccgtcgctgacgaacctgccgagcgccacgccgctgcaactgcggatccggctcaccgcgacggccagcggggggaagggctcgacccagcgcgacacccagaccaccgtcgtcgcggccaacagcaccgtcggctggcacgacccggtcgcctgctcgctaggaaggaacacgccgtgagcgctccccgacacccgcgtccgctgcccgcggccggcgaccgcgggtcgatgcccatcgccctgctggtcaccatggtggcgacgagcctcagcgtggtcctgagctccctggtgatcgcgcagatcggtaccacgcgcttcgaccagcggcgggtcagcggactgcagtccgcgcgcgcgggcctgcaggctgccgtggccacgatccaggcgtccacgtcgggtggcgtgtcgaccgtgaccctgtccacggcggccggcaacccgcagggtgatcgcaccaagctgccctgcgccccgatgaccgacgcctcgtccgcgggcccggccacctatgcggtcagcttcgactactacacgaccgacccgcagtacggcggcagcccgctggccccgtgccagaccggacaggggcccggcaaccaggccgcctacgtacggttgacgtcgaccgggttggacctcgcgggcaaggtcagcgtgacgttgacggccacgtaccccctgctgtccggtgaccagaacctggccggcgacaccgtccggctcgccgggaccaacctgtgcctggacgcgggcgacacgcccgtcgcgggcgggcaactggcgctgcgcacctgcgccgccagcacccggcccaagagccagctgttcgcctacggctccaacctgcaggtcagattggtgtcgtcgagcccgcccgacggactgtgcgtggacgcccagcagaccagcgggtcctccctggccctcgccgcgtgtggcaccaccaccgtccccgccactcagcagtggatctccgcgagtcccgggccgtccggtggcggtacctgggcctcctcggcccggaccctctgctggcgggccgcgggtcccgtggcgggcctgtcggtcaacctcgacgccgactgcagcaccgcgtccaccttcgtctcgcggggctcggccggtgcgggcgcggccgtgctggccgaccggaaccagtgggtggactacgccgagttcagccggtgcatggatgtcggcggacagaaggtcgccgacgcccggctgatcacctatccctgcggtcagagcccgagcctgacgagcgccgactggagccagcagtgggtgccggtggacgccaccagcggtcaggccgcggtgctcgccaacggggtcgccggcgtggcggacgtcctgttcacggtgaccgacaacgacgcaagcccgaccaacccggacggcaggtactgcctgtggagccccggaaccgccgggcagaaggtgcaggcgaaggcctgctccacgacaacggccggataccggtggacgatcacccggaacaccggcctgcccacgaccagctaccgggtccaggacgaccatgccctgtgcctgaccgcggtcggacaggacgtcctcgtggacccgggcgccccggcgaacacgagcattctccggacgatgccgtgcgacggctccgaccagcagaaatggaacgccccgtcgaccgcgcagaacgcgtcaccgctgctgaacgtgacgcagcggtagtgccggcaggatggcggcgagtgcacccaccagcaccgcgagcacggcgaatcccccgttcagcgtggtcgccgtggcgatcgcgccgaccagcagcggtccgcccgcgtcgcccagttcgcggcccagttcggcggcgcccatggtctgcccgagccgctccggcggggtcgagccggccagcgccgcgaaccccagcggggtgatcaggccggtgccggcgccgatcagcgccgccccggcgaggacgccggtcaggccgggcagcagcgccgcggccaggccgactagctagctaggcggtcagcccggtgcgcaggctcaaccgcccgtcgtcgagcgcccgcccggcccgcggctggaccagcgccgcgcacagcgccagcaccgacacggccgcgccggtggcgatcgggctgagcccggcggcccgcccggtgaccggcaggaagccgacgccgaccgacagggccgcggtcgcggcggccagcgccgaggtgggccgcaggaaggtcgccgaggtcagccggcgggccagatcgagcagggtctgccgggtcttcggcagcggcgccaggtgcgggacggccagcagcgcccagacggcgaccgccgcgccgagcccggccagcacgacgaacagcgaccgcagcccgccggcccagacgatcacgccgccgagcagcgggccgagggtgtagccgatcgacttgtagaagccgtacgacccgaacgcccgcccgtgcttggcgccgggattcagccgggccacgagggccgacgcggccggggagaacgccgaggcggccgcgccctgcccgagccgagcggcccacagccagccggggctgtccgccgccacgtagaccgcggaggcgagcgcgaacgcgaccaggccgccgagcagcaccggccgcggcccgatccggtcggcgagactgccgaacaccggcttgaggacgatctcggcgccgtcgtagagggccagcaggccaccgagcgtcagcagcgaaacctgcgccccgcccaggttcgcggcgatcgcgtgcgctccgaacgcggtggtgaacccggccgcgtagagtggccacatcctcttcacgagagtgaaagataaacgatgcgggtcctggtggtggaggatgagcgtcggctcgccgagctggtggcgcgcgggctgcgcgaggccgggcgttgcgccggccgggcccgacgcagcgtaaccgcccgcgccgcagccggccgggggatgccagcccggcacaccgccgaggtgcggcacaccggcgacgacgagctgctggccctgcaccggcattcccacgagtcggccgtggctgtgctgcaggccggtgacctgcggctcgaccccggcgcccggcgggtgttccgggacggcgcggagatcgagctgtccgcccgcgagttcgacatcctggccctgctcatcatctgagcgcccaggccgagcagctcaccaccgcggtcgggcggggcgggccgccgccggtcagcccgggcaccaccttccagctgctcgacgccggcaaccgggtggtgcccggcctgcccggcccgcggcggccccctgcgcgccgcggccaccacttggccgcactgccggcggaccggccacgggtggccgcggaccggctgttcaccgctgccggcatccgcccggcgatgcagccgggcctggttgcggggccggtggtgccgctggacactcccggaccggaccggtgatagtcactttctttagtatgcaactgtttgtatagtcgcggcctatgagccgctatccgacgctgctgagcccgctcgacctcggccacaccgtgttgcgcaaccgggtggtgatgggctcgatgcacaccaagctcgaggaccgcgagcaggacctgccgaaactcgccgcctacttcgccgagcgggccaagggcggggtgggcctgatggtgaccggcgggtacgcgccgacctggcggggctggctggcgccgttcggcagcaagatgaccagcggacggcacgccgacaagcaccgcgtggtcaccgacgcggtgcacgagcacgacgggaagatcctgctgcaggtcctgcacgcgggccggtactcgtaccatccgttcagcctcggcgcgtcggcgaagaagtcgccgatcaccccgttccggccgcgggccatgtcggcgcggcaggtcgacgcgacggcgaccgcgttcgcccgggccgcgcggctggcccgccgtgccgggtacgacggcgtcgagatcatgggttccgagggctacctgatcaaccagttcctggccgcccggaccaacgaccgcaccgacgcctggggcggctcggccgcgaagcggatgcgcttcccgctggagatcgtccggcggacccgcgagctggccggcgacgacttcatcgtgcagtaccggatcagcctgctggacctggtcgacgacgcccagtcctgggaggagacggtcgagctcgcccgcggcctgcaggaggccggggtgtcgctgttcaacaccgggatcggctggcacgaggcgcgggtgccgacgatcgtcacctcggtgccggccggcgccttcacctgggtgacccgcaagctgcgcgacgaggtgacgatcccggtcatcgcctccaaccggatcaaccggccggaggctgccgagcagatcctcgcggccggagacgccgacctggtgtcgatggcccggccgctgctggccgacgcggactgggtggtcaaggccgagcagggccgggaacgcgagatcatcacgtgcatagcgtgcaaccaggcctgcctggaccacaccttcaagaacacccgggcgtcctgcatgctgaacccgcgggccgggcacgagaccgaactcgtgctgctgccgacccgtaccgtcaagcgttgtgcggtcgtcggagccgggccggcggggctggcggcggcggtcgagctggccgggcgcggacacagcgtggagctgttcgaggcgggcgagtcgatcggcgggcagttccggctcgcggcgcgcattccgggcaaggaggagttcgcgcggaccctcgactactaccggcacatgatcgacgttcgcggggtgaagctgcacctcggggtgcgggccaccgtgacggacctggccggcttcgacgaggtggtgctcgccaccggcgtgacaccgaggatcccgcagattgccggcatcgaccacccgtcggtcctgacctaccagcagctggtggagggtgcgccggccggggagcgggtggcgatcatcggcgccggcggcatcggcttcgacatcggcgagttcctgctgcacgaccagaacgagccgctcgacgactggatgcggcgctggggcgtcaccgacccggcggcggagcgcggcgggctgaccaccgccgtcaagccctccgtccggcgcaaggtctacctgctgcagcgcaaggagaccgcgctcggcaagggcctgggcaagacgaccggctgggtgcaccgggcgacgctgcagcagtccggcgtgaccatgctgcgcggggtgtcctaccagaagatcgacgacgccgggctgcacctcaccgtcggcgagaaggcccaggtcctcgcggtggacacggtcgtgctgtgcgccggtcaggactcggtccgcgatctcgtcgcgccgctcaccgaccgcggcgtgacggtccacgtgatcggcggcgcggacgtcgcggccgagctcgacgccaagcgggccatcaaacaggccaccgagctcgccgcttcggtctgatccagagggaagatcatgggatacgtcagcctcaccatcgacaacggcatcgcccaggtacgtctcaaccggccggagaagttgaacgccctggtcctggacaccctgcacgagctgatcgcggttgcccgccggttgcgccgcgaccgctcggtccgcgccgtcgtgatcgccggggagggcccgtcgttcagtgccggcctcgacatcgccggcaccctgaaatccccggcccgggtcgtgcgtgccttcgtcccggtcccctggcgcggcaccaacctgttccaggaggcctgctgggcgtggcggcggatcccggtcccggtgatcgccgcggtccacgggcactgctacggcggcggcatccagatcgcgctcgccgccgacctgcgcttcgccaccccggactcgcagtggtcggtcctggagggcaagtggggcatcatccccgacatgtccggcatccgcagcctcaccgaggtggtcggcctggacgtcgccaagcggctcaccatgaccgccgagcggttcagcggcgcccgggcggccgagctgggcatcgtcaccgagctcgccgacgatccggtgaaggcggccaccgcgttcgccgaaagcctgctggccaagtcaccggacgcgatcgccgccgcgaaacgcctgctcaacggagcggtgacgagcagcgcccggcgcaccttcgcccgtgaacgctgggagcagatccggctgctgcggctgcccaacaccgcgatcctgcgccgcgccgtgctcgccaaggccaccccggagttccggccccgggcccgtaggatgcgtccgtggcactgaggaacgccgttctcgcggcgctgatcgaccgcgagtcctctgggtacgacctggccaaacgcttccgggtctcggtcgccaacttctggaccgccacgccgcagcagctctaccgggaactcgaccggatggagtccgaggggctgctcgcggcgcggctggtcaagcaggacaggcggcccgacaagcggatcttctcggtcaccgaggcgggccgggccgcgctgctcgacttcacccggcaggagccgaaaccgaccacggtccgcgacgagctgctggtccaggtggaggcgctggcctgggccgacccggccagcgtccggtcctcgatcgaggcgcggatcgagcagagtcgccggcggctgaccgcgtacgagcagatggtggtggagatcctgggaagccggagccacgcggagttcctcgccaccggaaaccggatcggcccctacctgacgctccagcggggcatcagcttcgagcgggagaacatcacctggggtgagctcgccctccaggtgcttcagtccaggtcgatgtagttgaagacggcggccggggtgaaccggctggcggtgccggtgctggcggtgaacgacacccagaccgggccggccgtggtcgccggcggcgtcacgcacaggtaggtgacgaaggtgccggtgccctgcctggtgcaggacgcctccttaccgccgaacgtgaagccggtcgcgccgcccagctccccgccggcgatcttcacggtgaccttggtgccgccggccagcgtgtcggtggtcgccgacaggttcaccacgaccggggcgtaactcaccgtcaccggcttgcccggcaccccgtcgtgcagcagggtcaccggggccgtcgccgcggccgaggccggcatcggcaccttcacgtgggtggcgtccacccagaccgggacgaccttcgaggtgccgaccgtggcgctgatcgcctgcgtgccgaactccttcggggtcgcgccgaccgtcccgccggtcaccgtcagcgtgaccgtgccgccggaggccttcgccaccgcgccggcgggaacttccaggcccagaggcgtgcggtacgtgacggtcccgctcaccgagccacccgcgctcttcaccacgaccggggccgccccgttcgcgccctccggcaccaccgcggtgatctgggtggccgacttgaccgtgaagctggtcgcgttcctgccgccgaaggtgaccgatgccgggtcgtcgctggccacgtcggtgaagccgttcccggtgatcgtcaccgtctcgccgcccgcggtggacaccttggccggcaacaccccgctcagcagcggcgcgtagcggatcgtcgactcggacggggtgccggccaccccgtcgtgggtcagcgtcagcttcatcgcgccgaacttcgtgccggccggcacggtcaccttgacgtgcgcctcgtcggtccaggccaccgtcgcggtggcgtccccgaccttcgcggtcaccttctcggtggtgaaggccgcggcggtggcgcccacggtgccgccggtcacggtgaccgggacgacggtgccgcccttcgccccggtcaccgcctcgaaccgggcacccagcggcgcccggaacccgaagctcaccgtcccgctgctgctgcccaccgtgttggtgacggtcaccttgaccgcgccgttcgtcccggccggggtgaccgcggtcagccgggtgtccgacacgacggcgaacgaggccgcgttgaggtcaccgaacttcaccgcggccgggttcgtcaggtccagcgacgagaacccggaaccggtgaccgtgaccgtggtgccgcccgcggtggtgccgctcggcggggtgaccgcggtcgcggtcggcgccttggtcaccggcttcgcggtccccggggtgtcggccagaacgctgaccgggacacccggcgccgcgccggcggcgatcgggtaggcgaggctgacagcggtggcggtggcggcggcgacggtgagagcggcccggcgcgcgtgcttcttggtggccatggaagacaacggtcggtgcggctgagtgtggaagcggtcgcctccggttgctaacgggttgcttcgaacacctcgtcgacggtctccggccgcacctcggcgagggacgacggccgccagcgcggattgcggtccttgtcgatgatctgcgcccggatcccctccgccaggtccggcagccgcagcatggccgccgacagccgcagctcctgccccagcgcggcgcgcagatcgggcaggcgcgctgccgtccgcagcgaacgcagggtgatcgtcagggcggtgggggagcgggtgccgatctccttggcggccgcctgcgcgcccggggccgggtgccgggccagccggtccacgatctcgatcaccgagtccccccggtagcagacgtcgatccactcccgggccgtggcgaactcacccggcggcggctcggccgtgaaggcccgcaccccctgcccctgttccagcgccgcgaccagcgcgggcaggcgctcggacgggacgaagaagtcggcgagcccggccgcgatcccgtccgccgcccccaccgcggagccggtcagcgccagatgcgtgcccagctcgccgggcgcccgggagagcagccaggagccgccgacgtccgggtgcatgccgatgcccacctcgggcatcgccagccgggaccgctccgtcaccacccgcaccgacgcgtgcgccgagacaccgatcccgccacccatcacgagaccgtccatcagcgccacgaccggcttcggatactccgcgatcgtcgcgttcaactcgtactcgtcagcccagaaccggatcgacccgctgcccccggacaccgcgtccgcgtggatcgcccggatgtcaccgccggcgcagagcccgcgctcacccgctcccgtgatcagcacggcccgcacggtgtccgacgccgcccacccggccagagcccggcgcatgatcgccaccatgccggcggtgagcgcgttgatcgcccgcggccgattcaggaccaggtgcccgaggccttcccggacctcgacgatcacttcctcatcggtacccatgatcttgttatagccccccccgcgccgcgacagcgtccggcaggcacggcgtggcggtgatcgccggggtcagagcacggcgagccggtcgaccagcagttccactctcgcctcggcgaacgcgggcaacaaccggccggtgcgggtcagggtggccaggccgtgcagcgacgaccagaagacctcggtgaacaggcccttgtcgaccccgtccccggcgacctcacccagggtttcccgcagcgcggcgaaggcgtccctgagcggcgccggggtgtcctggcgcccatacgccaggccgccgtccaggaggaacagcgcgtcgtagaccgccggatggcgcgcggcgaagtcgaggtaggcgcgggccagggcggtgacccgggctcgcgggtcgtccgtcgcgtccgtcgcggcccggacatgggcggccatctcggtggcgccctgcagggcgaccgcgccgatgatctcccgtttgccgcggaagtggctgtagaggacgggctggctgtactcgatgcgctcggcgagccggcgggtggtgaccgcctcccagcccatctgctcggcgagctcccgggcggtcgccacgatgaggcgctcgcggacggcccgttcccgctgcttgcgttctgttaccgacacgggccgatcctagcactgctagacatgggatcgatgacaatgctagcctcgatccgaaagctagcgccgctagatacctggagaggttcgccatgctcaacgctctggaagtcatcaccaccgtggtcgtcggcctgatggtgggggtcgagttctccgtcgccttcgtcatgaacccgatcctggacgccctccccgaggacagcggccagctcggccacgcacacggcggccggatgctcggtcggctgatgccgttctggtacatcggctcggtcgtgctgatcgcgatctgggcggtggccggccggcggcacgacggtgacgggctcgtcgtcaccgccgccgggctgctgatcgtcagcgtgctcatgtcggtgctgctcctggtcccgatcaacaaccgcaaccggacctggacgccggagacccggccggccgactggaagcagcagctgaaccggtggctgcgctaccactacggccggctcgccgtcatcctcgccgccttcacggtgctggtcaccgccctggtctgagcgccacggcgggtggccggcgtcagccccgcaggatcgaccagccggggccggggacgagggtgccggtgccgccggaggactcgacgacgcgggcggggccgaggtccaaggggaagtcgtggccgtggtcggcggcgttcagcagcacgatgaggcggtcggggccggcggacacctcgtacgccagttgtttgttggtgaggtgcaaaggtttcgtggtggcgcggtgcagccacgggaatcggcggcgcaggctgatcagctgctggtgcaggtggaaggtgggctcgccgaacggggccagatccgccggggtcgcggggaaggccgggcggatctcgtcgtcgccgaactcgatgtcgcgtttgacgccggtgaaggcctgctcgtcgccggcgtagacgctgggcacgccgccgacggtgaacaggacggccagggccaggccgagatggcgcggctcggtcagggcgctggcgatccgggtgacgtcgtgattgccgacgaaggtcagcggggggaaatcggcgccgaacgcgtcgtgccgctccaacgcccaggccaactcgaagaagttcaggtcgttcagactggaccggatcgccttccacagctcgtactgcgtcacggaatcgaggccgccgtcacgcacgaaagccggatagtcgccgtggatcacctcacccacgaaccagccgccgtcgatgctcccggcggtcgcccgccagaacggcagcggcaccgcataggccgcgtcgagacgccagccgtccgcgccgaactcccgccagtgccgcatcaccccggcgacgtagtcgacgacggccggctcatcgtgattgagggcgaccagatggtggtgaccctcgaaatcggcatggtcgaacccgccgtcgtcgttgtaggaaagacgaaaccagttggcgtacgccgaatcgcgcccccggtcgagcacgtcccggaacgggccgaaaccgcgccccacgtgattgaacacgccgtcgaacagcacccggatcccgcgccgacgacactcgtcgagcagccaccgcagatcgtccgtggtgcccaaccgcggatcgacccggtagtggtcgaccgtgtcgtagccgtgcgtctccgccgcgaagaccggccccaacgccagaccgttgcagcccagctccaccagatagtccagccacggcgcgaaacgccgcagccgcggcaccggcgcggcatccggtggcagcgccgcccgctcagcccccaggaacgtgaggggatgcgcgtgccaccagatcacgtgctcgacccagtcgttcatcgtgaagcgtctccgatccggttggcccgagggacaacgtacccgccgggccaccggacgacatctcagaactcgccgctcagcagcatccccgcggcgaccgccgcgccgtcggtgcggatcgtgccgcccacctcggcggcccgtgcccggacatccgcacccagtgccgtggccagcgccgcggacagcgacccgaccgtgggggagcggccctcgtgtgccaccccgatgccgagctcggcgatccgctccgccgacatcgtctggtcggcgatctgcggcaccaccacctgcggcgtccccgaccggctcgccgcggtcgtcgtcccggccccgccgtggtgcacgatcgcggccacccgggggaacagcgcctgctggttcacctcgcccaccaccaggcagtcggcgccgtcgtcgagcgcggacaggccggcccagccccggttgatcagcacccggcggccccgcgcgcggatcgcctcgacggcgacccggccgatgtcggccggcaggtacgaggcgatgctgccgaaacccacgtacaccggcggctcgccggcatccaggaacgcggtcagctcggccggcagcggacggtcgtccggccggatccacgcgccggtctgcaccacgtccaggtcggtggtgtccgcccacgggcacagcaccgggtcggcggccagcaacggccggtcggtgaagacgtacgaccggatgtcctcgaccggcggcatcccgagcgccgcccggtgccggttctccggctccgcgtacagggcgttgatccggtccgcgtcctccttccacagcacccgcggatcggtctcctgcgccgccgactgcaccccgggccgggtgcccggccggcggtgccgcgacggcagcccgtacacgtggaagcaggccatcgcataccggacgcccaggtggtcggcgaccgagcggacaccggacggcatcaacccggtcgccagcagcgcctcggcccccttcgccacccggcccagcgtctcgaaccgggccgcgaccagatccgccgccagccggaacgcgtcctgcgccgacggcggccggctgccggccaccaccgaacccaccgccggccccagcggcacgtgctcggcgcccaccccgttcagcagcgtcgtgaactcctcatccggcggcgcgcagacctgcacctcggccccctgtgcccgcaactggaacgccagcgcggccagtggttcgacatcgccccgcgaaccccaggtgctcaacaccacacgcatcttcccggcccccattcaacgattgcggcagccagtgtgcgccggtgacggggtcttgcggcaagcccacccatgcgatatacgttaaagtgggagatggcggtattccacgagctgtttccgcttcgcgagttgtttccgcttagcggatcccttcgtcaccggtggcccgtcaccggtggccggcgagcgccagggcggtgtccagttcccgcagcttggccggggacagcgtgccgatcctctccaccagcgagtcgacgctgacggtcgcctcccaggtgcagaagaccttcccctcccggggcagggccagccggaccacaccgctgcgtggcaggccctcctcggctccgaggaagacctcgatgccgccggcccgcgtatccggtccggcagccgcgaggatccggcaccgctcgtcggcgtcgaccgcttgcgcgccggacaacaggacgaacccgatcttctgcgccggcgtggccggttcgacgacctgcaccgccgcgaacgccggcccggggccgcccgaaagcagcacgacgggctgtttcccgtcgatctcagcccaccagacctcgccgcgctccacatgtcctcccgggtgcggtcccgctcagcgccgcccgcccgaaccgcgatgccattgtgcaccgccggcgctggcggccgccgggttcgcgcaggcgctcggcaaccggtccgggatccgagtcgcgatagtcgatcatcgagcggcatactcggccggtgcgccgcccgatgagtcttgccgtctccgccggtgtcgcggtcgcctgtggactggccgccgtcgccgtcaccgcttcgtcccgccgtgccggccccggggccggcacggccacggtggccgctgtcgccgtcagcaccggcgctccggtccggccggccctctgcgacgccgcgcggcccgccccgcgcgacccgttcccgttcaacccggacgccgccggccgtgaccggctgctccccttcgtcgacctgctcggcaacggcgccaccttcaccggcggcgccgggtacttcgggccgctggacgccgccgggctggccgcgctcctcgacgggaagtggctggacccggacgaccggcagaacgccgccccgtcggcctgggacatcttccggttcgtctgcgaccacccgggcacccacgcgcagggttacgcggtcagcccggaccgggacgactaccgggtgtccctggagaccgtctgggcgccgcggatcgacgacgcgctgcgcgccgacgcgaccaggttctgcgccgacgcggacgccatcgagacctccgaccacctggagtgcttctgggactgatcggcggccggccccttcgggcgatatctgccgggacgaacaggacggcaacctctacagtgcgtcgatggtgacgaagctcgatctcgtgtgtgccgccctcgacgcgctcttcgaccttgacacggcggcccccgacgcggcgatgagccggcatgtcccgcgggtgtacgacgaggccggagtcgactggcgggcgttcgtcgagccgcgtttcgcgcaacgattcaacgggttgatgcaccgcgggcatccctcggtgggtgccgtccacggcgcctgcctgccgtcggcgcaggtgctggacgactggctctccgtcgcgcggaccggtgacttgttgatcactcaccatcccatcgacatacggaacggctcgcccgaacacgacacctgggcggagggtttcgtgccgatcgccgacgcgcaccggctggccatcgtcgagcgtcaactgtcgatgtactcctgccacgcgccgatggacacctcggtgcgggtcggtaccgccgcggcgatcgtggagggcctgggcggcaccgcggtggactatttctggccgtacgacgagggttacgcagggcatgtcgcggacatcgcgcccacgacgaccgacctgctcgtgcgccgtgcccgcgaactgttcggcctggacctcgtcgaagtggaaggccggtcacgcgacgacatcacccgcatcgccgtcgtcggtggcgtcggcgaccacgtcgatcagatggccgaggcggagaggctcggtgctcaggcctacctgaccggcgagctgcatgtgcgcatcgagggtgactacggccgccgcaagttcgccgacgtgcagaacttcgccgccacgaccggcatgaccttgatcggggtgtcccacgcggccagcgaacacctcgtcatggagacccagctggctcgctggttcacggggacgctgggcctcaccctgcacccgatccgcgaaaccgactggtggcggtaggccgtcgggctgatacgctcccggcgcggtgggatcggtagtgcagaggtcggcacgtcgccctgtcaaggcggaggacgccggttcgaatccggctcggtcccatcgccctcggcgtactcgtcctctgggcggggcgtatctgaacaagaccgcccggggcaggttctgcgtggtcagcctgtcggtgcgcaatgtcggcgatcgggcgcagatgttctccggcagcaaccagaaggcgctggattccgccggcaccgagttccagaacgacggggccgccgaaatggacgccgacgaccacgcggacacgttcctcaacgacatcaaccccggcaaccgggtcagtgcgaaggtcgtcttcgacgtgccgcgcagcaccacgctgacccggatcgagtggcacgactccgcccggtcccgtggcgtcaaggtcgccccgaggtaggtaggctgcgggcgcggcggggccggtagcgcagctggtcgacgcacaccgttcgcatcggtggggacgccggttcgaatccggctcggctccgccgccctcgatcgctacactccccccttggcgtgccgtagcgcagaggtcgtcgcatcgccctgcacaggcgaaggacgccggttcgaatccggccggccgccaccacgaggacgggcggggcacggtggatctgggacggcggcgggaccgcgacgactatgcgcggcggatggcgtacgcgtcgcccggtggcatgatcgcccgggcgaccgcggcgcggctggccggtgactggcgggccgcgtgcgccgcggcgatggtcgacgtgcgcttcgagccggccgcggtgcgggaccggttcggtgccgcagcgaccgcggcgatcgaggacgatctcgccggactggcccctgacctgctgcgtcgccacctgccggtggacacctgggggcggtggccgtcccgggcccgggtggtgctgtcgagccgtccggagccgttccgcgagcgccgctttctcgcccgccggcgtccgcgggttccggtgctggtcgcgacgctcccgcgggacgggctggtcgcccggcgggtcaccctcgaggtggtcgacgtccacgagctgtccggggtctgggtggatctgccggcctgggcctggcacgcggacgcgatcgaggggcgccgctgggcctacggggcctcggcggcacgtctgccctggcacttcgcggacggcacggcgtacccgcagggaaccgtgaccgacgggaccgatcgcgccggcgagttcgagcgccttctcggcccgatagatcaggatcgcaggacggagtggtacgccgcggccggcatcgccgtgcccgatccgcaccgcgacgcctggatcgtgcagcggctcgccggtctgcaggatcggctgccggtcgccgcggccgaggcccgccggctgatcgaacggctagctagctagccgccccggggggactgttccgcgccgagccggcggaccgggtcgccggtgagccgggcggcgggccggccgcgttcggcgtcgccgcgccccgggacgccgcgctgctgcgctggggcatgatcggcccggatcagctgcatccgctcgtgcacgaggcgctgttcccgggccgggtccagcactggcagccgatcgagcaccggccacgccggacgttccgggtgctgtgcggcggccggtggcatccggtcgaggcggccggggcgagcctgcgcatcctgcaccccgaccatccggtgacaccgaacgggtgcacggccgcggtcgaccggttccgcaccgccggcgccggcaccccgaagaaggtgcgccggctgcgccagcgggtgttcgagcggatcgtgcacggggacaccgacgcggtgctggccgatctggcggccggctgtgatccgttgctgcgcgaccagcacggccggacgctgctgcactacatcgcgaacgtcgagcatgagcgggtgctgccggtgctgctggccgccggcctgtcgctcgccgaccgggactacgacggccgcaccccgctgcatgtggccgccctgtcggcggacaccggggcgatggccgcgctgatcgccgccggcgccgacgagaacgccttcgacggccgcggttcgaccgccgcccaggtccggcgggtcgggtcctgacgtggaccgcgcggacctcgacgccgccgtggctgccctggcccggctcgacgacccggagctggacccggcgtcccggctggagctggagcgtgcggtgaccaccgcggcgcgccggatcaagcagcgggcgaaggcccggcggtccgcgcagtcccgggacgccgaccggaccctgctggccggggcgagccggttccggaccgagatcccgtccccggagcccgtcgcacccgccgcaccggccgagacgctgggcgtgctgcgccgggtgcggctctgctacgtctgcaagggcgactaccgcgaggtcgacgccgactaccaccagatgtgcccggtctgcgcggcggagaaccgggactggcggcacgcccgcaccgacctgaccggacggaccgcgatcatcaccggcggccgggtgaagatcggcttccacaccgcgctgaagctgctgcgcgacggcgccaccgtggtggccaccacccggttccccgacgacgcggcccagcggttcgccgccctgtccgacttcgaccagtggggtgaccggctgcacctgcacggcctggacctgctcgacctcgacgcgctgcaggagttcgtacgcttcgccgggcggcgtttcgaccacctcgacatcctggtcaacaacgccgcgcagaccgtgtaccggccgcccgcctactaccgttcgctcggcaccgcgcccgaactccaggctctcgaccagcggttcttcccggccgggcgggtcgacgagaccggtttccagctcgacctgcgcccggtcaactcgtgggtcctgcgcgacggcgaggtcagcccgcacgagtggctgtccgcgcacgtggtcaacgcgttcgcgccgttcctgctcacctcccggctgcgcccgctgctggccgccgggccgccgcgggaccggcacgtggtgcaggtgtccgccatggagggcagcttctcgcggaccggcaagacggtccggcatccgcacaccaacatggccaaggcgtcactgaacatgctggtccggacgtcggcgccggactacgcccgggagcggatcctgatgaacgcggtggacaccggctgggtcaccgacgagcggccgcacccgcacaagcaggagcagcgggccatcggtttccggccaccgctggacgtcatcgacggcgcggcacgggtctaccatccggtcgtggcggccggccgcggtgcgccgatcagcgggaagttcctcaaggactatcggagcgtgccctggtgaccatgccgatccgctgcccggcgatccagaacccggacgacggcctcgccccacccgccgacttcgacccgttggtcagctggctcgccgagggcccggccggcccggctgtcttcccgcgcggggcggtccggcaggacggtcgcctcgacctgtgcaagcagggcgtcggcccggtcgaggtgggccggatcgccgccgcggccgccggctccccgcacgtacggcacctgctgctcggcaccaacgcgctgggcaccgagggcgtcgaggcggtcgccggcgcgctgcggcccgggcacggcatcgaaaccctctacctgggctgcaaccggatcggcccggacggtgccgcggtgctcgccgagcggctggccgccgacgacacggtccgcgccctctggctcaaacgcaatccggtcggtgacgagggcgtcgcgcggctcgcggcggcgctcgccggcaacccgatcctgcgtacgctcgatctggtcaacaccgggctcaccgtgaccggcctgaccgtgctgaccgacgccctggtcgccggcggcgcccgtctgcagcggctgttcctcggcggcaacggactcggcccggacgccgtcggcgtgctggcccggctgatccacgaggccggcgtgcacgagctgtacctggccgccaaccatctgggcgaccggggcgccgccgcgctcggcgaggctgctcacggcgtaccggcaatcctgggtctcggcggcaacgggatcaccgcgaccggcgccgcggccctggcccgcgactgcgccgcctggcagattctggacctgagccggccaccgtccgagcgcgccctcggcgccaccgccaacgacctcggcgacgagggcgccgccgccttcgcggccgcgctgcccaccgcccggctgcgccgcctcgacctgcgccggaccgggatcggcggccgcggcgcccggctgctggtcgacgcgatcgccgacgggcatcccaccctggaatacctcggcatcaacggcggcgttccccgcaaacagcggcgccgcgccgccggcctgctcgccgaccgtccctcgaccaccccgcacccggacatccgcgcgatcgccagcatctaccgctgacacccgcgccgtacctgcagtgctggctgacggtctccgcctccggcgtccttgaccgggtggacgacctggcgtcgcagttgcgggggcacggcttcgccgacggcgttcgggtggcggccctgctgtgcctgctcgtcggcgtcggggtgatccgcaacgacgtgcgccgctcggtcgccttcgccgccacccgcgattggcgggcaggctggggggatggaatcggtgtgggattatccgcggccaccgcgggtggagcggacggccgcgcgggtgacgatcgttcaccaggggcgggtgatcgtggacagcgaccgctgctggcgggtgctggagacctcgcacccgccggtctactacgtgccgcgcggcgagatcgccgccggggtgctggagccgggggagggccggtcgttctgcgagttcaaggggatcgcggcctactgggacctggtcggggacggcatccgggtgccgcgggccggctggtcgtacgaggatccttcgccggggtacgcggtgatcgccggcgcggtggccttctaccccagccgggtgggcgagtgccgggtggacggggaactcgtccgcgcgcaggagggcgacttctacggcggctggatcaccgcggacatcaccggcccgttcaagggtggcccgggcaccaccggctggtgacggcgcccgtctgacctttccgggacggataagatccgggccggtcgcgccgaacgagggcagcgtgacgacggatgacgacagcaagggcttcgtgccaccgcagccgatcgagttcgccggtgccgtgccgtggacgccgccggccgggttcgccgggccggtcccggcccgcgcctagctagctaggcggtgttcgccggggccgggctcctcgccggcctgatcgcgggcgtgggtctcgcggtggggccgctgcacgatccgctcgcgtcgctgtcgtcgaaggcgtccagcgagtcgccgcgaccgacggccgcgccgtcgggccgggggccggtggtgccgctgggcgacgcgctgaccctgaacctcgccgacgggcactacctgaaactgggcatcgccctgcaactggcggccgggcagccggacagtctggacgtcaacaaggctctcgaactggcggtcgacaactacaccggccaggatctcggcgaactcagcaccgcgcagggccgggcgcggctcaagcagcagctgctggagaagacgcaggcggcctacccgggtgtcgtgtcggacctctacttcgtccagttcgtcacccagtagggcgcggcccgccgcgtcacagctggaagcggtcggagaccaggcgcaactggtgggacagctgggcgagctcgacggcggccgcctcggtctggttggcggcctcgtgggtcaggaccgtggtgtcggtgacccggccgatcgaggcggacaccgcggccgccgagcgttccgcgacctcgacgttgccggcgatcaggtcggtggcgctggtctgcgcctcgaccgcggtggagatcgactgctgcagctcgtcgatgcgggagatcacctggccgatccggccgatcgcgtcgaaggcctgcccggtgtcggtctgcatggcggtcacccgggacgagatgtcgccggtggccgtagccgtctcccgggacaggtccttgacctcgccggccaccacggcgaaacccttgccctgctcgccggcccgggccgcctcgatggtggcgttgagggccagcaggttggtctgctcggcgatcgaggtgatgatgctgatcaccgcggagacctcgtcgctggaactgcgcagccgctcgatcatccggttggcgtccgaggccaggccgacggcgtcgcgggcgaccgtgtccgcctcggcgaccgcggtcgtgatcgcctggatcgagctgcccagaccgcgggcggcccgggtggattcgtgcacgctcgacgtcacctgctccaggtcctgcttggcgaccgcggcctcggacgacgcggtgccggcgccctcggccaggtgccggctggtcgcggtcagctgctcggaggccgcggcgacggagctcgcgttcccgctgatctccgacacggcggtccgcaaggcgctgacgatctcgttgaggctggtgccgagctgggccagctcgtcgctgccaccgaggcgcgcctcgacggtcaggtcgtaggcggcgatcgaccgggcggccgacaggcagctgttgacccgctgggcgatccggcgggcgagcagcatcgccgcaccgccgagcagcaacgcggcgaccaggcccaccaccacggtcagggtcttggaccgcttggcggccgcggcggcatcgtcgtacgccgccttcatccgctcgttgatcgcggcctgcagcgcgccgatcgcctgggccgccttgacgtcgaccgcgtcgtaggcgggccgcgccgcgagcgccgccgtccgcttcgggtcggacgccacccggctggccagcgtgacgatccgctgcccggacgcgatcagctgattgagcaccggcaggaccgcgtcggcctggggccgcacctgcggcatgtcgcggatcacctcgtcgacgccctgccggacctggcgcacgttcctgcccagccggtccaggacctcctggcgttccttggcgtcgttggtgaccagcgcggccaggacgctgccgcggaacagcgaccgtgcgatgtcggccgactgcgccgcctgcagcgcggcggccgcgttgcgggtcaccgcctgctgctcgtcgagcgcggacgtgccgaggtatccgatggcgccggcgaccgcgaccagcaggaagccggcgacggcgagagcggcgatctggcgccggatggtgagcgtcacgtggtaccccccgaccgccgacgataggagaatctagctggattcgtcgcgaatccgctcagttcggtcgccgaccggccgaattgcggggcatgggacgactggcccgtcttctccttcccgccctgctggtggcgaccggcgcgaccggttgcggctccgcgaccggcgccctggggcagcccgtcgaccggctggccgaggcccgcgccgcactgccgcccggcatggccgacggcggggtgctggtcgccggcaccgacccgacgttcgagccgatgacgttcaagcagggcagcacctacaccggtctggacgtgcagctggtcgaggcgatcgcggcccggctgcggatgcgcgtcgactggcggacggtgagcttcggcgacctgctcgaccaggtgcagcagcacaagatcgacctgtccgtgtcgtcgatgttcgaccgggccgaacggcagaagaaggccgacttcgtcgactatctcaacgccggcacgtcgatcgtggtcgccaagggcaccggtgacgtcggcggcatgcccggcctgtgtgggcggcgggtcgccgtgcagccggacaccgtctacgtcgacatggcggccgcgcaggccgcccggtgcggcggccggaaactggtctcggtacgcagcgacaacccgtcggccgcggtcgcccagaaggccgccgacgctgccctcaacgacttcccgatcgccgccctcgacgtacagaagaacccgggcctggagctttccggaccgcagatcgaggccatcccgtacggcatcggcatcgccaaggatcgtccggcgctgaccaccgcggtgcagaccgcgttgtactcgctggtcgacgacggcacctacgacgccctgctgaccaagtggaaggtgaccgagggcgccctgcgcaccggtgccgtcgacggcggcgcgtgatccgtccggctcagcttgccggtcgggcgccttctcccgcggacatccgtcatggtggaccagacggtcggcacgcgtagccgatcgcgcggcaaacgtgaaaggccgttcctcccgccttgccgatcggagttactgtatatccgctcaggcggatggcagaggaatggagcactgtgcccatcgatccgtccaaggctcccgcatcaacttcgccgttgtggataatcgcgctcttcatcgtgctcagcgaggtgatggcgggcgttgcctccatcgccaccgacggagcaacccgaataatattcgcggtgtttgcggtgggatttccgctgattgtcttcgccgtgttctcctacctgctggtgggtcacaccgcgaagctttacgctccaagtcagtacagtgttgacatcgacccggagcgcttcgctgtcggtgtgaatgccggcggcttcacgcagcctcaggtgacgctcatcgccgaagcggtggcccaagccatcgagcagtccgaaccggcttcccatggcgacgcgaacgtggcgtcacgagctgtcgaggtgttccgccagacgatcttccagtcatctgtcgcggtcgatcttgacggcatcggcgatggaggttcggacggtctcgtgattcccgtcgaccgcggcacgggagtcgatgactttcttgatcaggtctggttcgcgatgcggggaaggttcagggcgttcacgtatggcaaggactgggttctagtggacgacgagaaccggaaggagttccgtgaagctgggactgcctgggcccagaagcatggtgaaacccgcgatcggcgtccgctttcggaaatcggaatctctcctggatcgaacctcagggttgtggcgttgtagtcccgttggaccaggaacgagtggacagggtgaggcggtagccgtccgggtcgacgacggtgacaccccagcggtcccagtacccgccctgcgcgacccggcggccgccggcccgctccagccgggcgatcagggcctcgtcgaccggcccggccaggtagaggacgagcaggtccgccgcggtgggcgacggctcgacggtcaggttcgggccgccgaccagctccaggtgccaggtcgcgccgggccagccgagcatgatcaggtcgtgctcgccgggttgcaggtcgccggtcgtgcgccagatgacggtcagcccgagaccgtcgacgtagaagcgttccgccgcggccagatcgcgactcggacgcgctatccggacggccaccgtgggttcgatcatgctctcatcgcctcgtctcgtaccgggtcaggagcacgccgccggggaaggcgcgggtctccaccaggttcaggttcacccagctgtccagggcggtgaagaacggcgtgccgccgcccaccaggaccggcgcggtgaccagcacgtattcgtcgatcagcccggcccgcacggccgccgcggccagggtggcgccgccgatgtccatcgggccgccgtcgccggcccggagccgggtgatctcggcgaccgcgtccccggtgaccagacgcgcgttgccgtcgaccgcgccgatcgtcgaggagaacaccaccttcggcatggcccgccagcggccggcgtactcgatctgcgccggggtggcatcaggccgccggtcggcggtcggccagtgcgcgttcatcgtctcccacagccggcgcccgtacagtgccagcccggtcgcggccacccggtcggaccaccactggaacagctcgtcactcggcgcgccccagccgaggtcgccgccgggcgcggcgatgtagccgtccaggctcacgttcatcccgtaggtcagtttccccatcgtgccagtctcccgcagggggcggctcccgtgggatcgctgcccggtgggtatgtacacgcatacccaacgtgtgtacgcgcgtacatatgggcgcctcgctcggcttcccggtcgggatggcgcgggcggcgacgatccgcggatggccgccgcccgggacagggtgatcgcgtcgatcggttaccgcgcgttcctcggcgggccgccggcgatcggtttcctcggccaccatgtcggcgtgctgagggcactcatcgtggtggccgccctgccggccctcgcggtaccgatcgccggcagtgtgcggccggcgcaccgcgactgattcaccatccgaccgcgaccagcagatactgcgggtcgccgtgcgacacgaacgaactctggccggccacgtcgtcataggggaacccgtaggccagtctccccagcgcgtggtcgtgccagaatttcgcgtagtagttggccggcgccgcccggtagaagttcgacggcgtctcccactgcgcctgcggcaggtcgatcgtgtgccggttcagcgccgcgcactgctgcggctgcccggcgagcaccccggcgcacccgaagatgtccgacgtgatcgcggtgatcccgttctgcgccgcgtagccggacagatagttctggtactgcccgccctgccggaacgccgcgtcgctgcccggcgccaggatccggtacggcgcggtcgccgtcgccaggtgcttgaactcggccggcacctcgtcggagaacttctggaaggtcaccgcccggtcctcggtgaaggtctggtaatcctcaccgacctgcacgtcgttgccgtcgtgcgaatgcagccgcatcgcgatcttcaacccgaaggcgtcgacccgcgtggtgttgccgttgaactggtccggtcccacggtgaattcgatgaagtcgtagtactggctgttcggcgagccgaggtagaaatacatccgcccggcggtgttggccggcatgtcgaaatagggctgctcggcgatcgagtgcgcgaccccgttgtaactccagtacacctggctgtccggatatctgccgttggtgcggttcaagatcttgacctgcaggacgtttccagccgccggaatgccgctcgtgtcaccccagaaggagtccggcatggtggtgccgcccggcggcgtgccggtgccacccgtcgtggtgtgcacgacgaaggaccacagcgagtagccgtaaacggtcgcccggacggtcccgttcatccgcacgtaccgcccggtgccgctgaccgtcagcgactggttgccgccggcgccggtcgtcgtgctgtaggcggtcgtccaggtgctgccgtccgcggagatcaggatctggaaggacctggcgtacgccgcctcccagctcagctccaccccgcagaccgtggcggccgcgccgaggtccacctggatccactgcgggtcgctgaacgcgctggaccagcgggtactcgcgttcccgtcgaccgccttggccgccgcggtgtcggcgttctccgcggaggacgcggtcgccgtggcgccacgcgccgagtcgttcgccgagcatccggacgccgtgaacgttccgtggacctggaactcccacagcgagtagccgtacgcggtggcccgcacggtcccgttcatccgcacgtaacgagcggtcccgccgactgccaggctctgcgtaccgcccgtcccggtggtggtgctgtaggcggtcgtccaggtggtgccgtcggtggatatcaggatctggaaggacctggcgtacgcggcctcccagttcagggtgaccgagctgagggtggcggccgcgccgaggtcgacctggatccactgagggtcgctgaacgcgctggaccagcgggtgctcgcgttcccgtcgaccgccttggccgccgcggtgtcggcgttctcggcggacgacgcggtggccggccggccttgggagagcagctggtcggcagcctgcgcggggccggcgaagaccgccgcgaacgccgcgaccagcacggtgatcagggcgccgatcagtaggcgccgtcgggggacagggctcatcgaacctccaggggagcgggccggcgggactgtgagagcgctctctaaggagtttcatcggttaacgcctatgtaacaaggtgttcacggttccggaaccggtttcgtggtggcccgtgtccggccggccgcttgctccggcggtggtgatcgacaagactgcagctgtgcgacggcgagcggtactcaccaccctggcggcggcggccggactcccggtccgcccccagccgcaacccgtcggcctgcagttgcgctacaaacacctgggcgacgcggcacaggcgatcatcgtgagcggcgagagctggacgtcgacgtatgccacgttgcgcagcttccagcgcgacagcgacggccggtggcaggtggcgtacccggcgatgccggcccgcaccggctacggcgggtgggcctgggcggccaagcgggtccaggaccgggggctcaccccggccgggacgttcaccctcaccgagggcttcggggtgcaggcgaacccgggcagccggctgccgtaccgcaaagtcgacggcgacgactactgggccggcgacaaactcgacccggcgacctacaacatcttccagccgtccgcacccaccacccgcacctggcggatcaccgaatcggaacgcctcgccgactacccgacgcagtacgcctacgccgcggtgatcgacttcaaccgcccggccggcgtgcactgggacgcctcccatgggcagaacgtcaccgccaccccgtcccacgtcggcgccggctccgccgtcttcctgcactgcagcggcgccggcaacaccgccggctgcgtctcggtcggcaaggacgacatggtcaccctgctgaagtggctcgacccggcccgccacccccgcatcgtgatggccccggcggccgacctgcacagcgcctgacatcagcggaacggggcgacgaaccgccgctgccacggcatctcgacggccccgggagagtggtgggcccgggcgtagccgaccgcccggtcaccaggcacgccgtccaggaccgccaggcgggaccatcgaggcccgcaccgacagcccacggctcaccacggcacatccctgacgagccgggcgaaccaggtgtcgccgtacgccggacgggtgcgccggtcgaagcggtagccgagccgatcgtagaaccgccgggcaccggcgttggcctcccacacctcggcgtgggccgtccgcaggccgcgacgccgccagctgtcggcacacacccggtgcagcgcctgcccgacaccgcgcccctgatggtccggccgcacctggatctgccacaactcgccgatccgcgtcacgtcggcggccgggtcgtgcggcgggccgatcagcgccatgccgaccacctcgccgtcgtgctccgcgaccagcagctcccggcccgggtcgccgaggatcgccggcacataggcgccgcgcaccaccaccgcccgtgccgccagctgcgcagcgctctgcacgtcccgcaggaccccgttgcgcgcggcgacatgcaccccggccaccgcatcgagatcccccacccgcgccggccggaccaccgtctgcgtcccgatgcgctccccgccgactcccatgatccaagcttatcgaggcaagacatcgacacagtcaaactattggtggtacgcgttaaggtgccccgtgtgatcaccgacggggtgcatgtccacgtgtccaacgcggcggcgatgtggcgggtgctggtgcccggcgcgcgtgagctcggcgatcatctgcgggccgaccgggccccggcgacccggttgctggtcacccgcccgctaccggccgcggccgtcgccgcactgttggcgaccgtgccggacgggcgtccggtgacggtcgaggacacgttcggcgcggaaccggctgaggccgccggggccacggtgcgccgcatgccggtgatgaaccggccggccggcccgccggatccgcgcaacgcgcccgatgtgcgggtgaccccggtgaccgccgccgacgaactcgccgtggccgagcggatcatggtggagagtttcccgatgtccgagttcctgccgctggtgcgcggcgcggcgctgcccgagcgcctgctcaccgcgcccggctggcaggtctggctggcgtatctcggcgatcgcccggccgccgccgcgtacaccttcgacgacggcgtcgcggccggcgtctactggctggccacgctgcccgggttccggtcgcgcgggctggcccgggccctgctcgccaccgcgatcgcggcctacccgacgcgcgtcttcacgctggtggcgacagcggccgggatacctctctacgagtccctcggcttccggacggtgggtacgaccatctggtaccggagcccgggcgccgcgcgctgaccggcgggttcgccgccctgccggcaggacgaccaacggtggacgcggcgaacccgccgcccggcatcctccgagggcgtgcgccaccgcgtcgcgctcgtcgtttcgtagtctctatcggtgcacatcgaattcacccatgcgcggtcgtcgaagtacttccgccgcaggttcgccgccgccgggtcgaaggccgccaagccgttcgtgatcccggcggtgattctcggcgtgctgggctggctcgtcttctgcgttgccgggtcggtgcgtaacgagctcgcggtgggtgcggtgttggtcaccatggccgtcgcgctcgccggcgtcgggttctggcggtggaagcgtcaggtgacggtaccggccgcctggcgcggacctgggtgcttacccggaaggaattcaagtcccgcaccgcggagacatcgaccgagcttccgtggtcggcgttcacctggctctggcaggacgacgacgcctacctgctgcgtaccggcgacggcaagacctgggacattccgcgagagccgctgaccgcggaacaggatgccgtgctggccggtttcctggacgggctccgtcgggcctcttgatgccgacggatcgtggtgaagtccatggggtcagaccgcgggcgtaggcaccgacatccggatccgctgccgacgagctcggccgttggagtcggtcacgatccggtcgaagtggcgggccggggcactccctggcctgccactccttcaccggccgtagcgtcagttcacggttgtgccgtagggctgagtgatgatctccatgccgtgccctgccggatctttgaagtacaggccgcgtccaccgtggtggtggttgatctctccaggctgcttcaggtgcggatccgcgtagtatgtgacgccggcctcccggattcgcatgaaggccgcgtcgaactcctcatcggaaaccagaaacgcatagtgctgcgtggcgatcggccccgccgggatggcggcgaagtcgagtgtgaccccgttgccggtggttaccggaatgaacgggccccactcggctccgacctcaagtcccaggatgcgtgccaggaactcggccgactcccggctgtcccgggcgtggacgatggtgtgattcaactcaactggcatgtgtggatgcctccgcaaggcaatctcacgggcacctccatgcctcacccggccggtgaccgacacgcgatgccgtgcccacgatcctaaagaaccactcgcaccacgtcgaggcccgctcaccagcaggcaccgatagccactcatcaccaccggcacgtccagcgagagtaagaactgacgacggttgaataggtgctctgaacagcattgaggaccggaatgtgagggtcggggagggcgatcggtgtctagtgcgttgaccacgaacgttcaccgggtccgatccgtcctagctagctagccgccgttgagagtgaggtgttcccagcagttaccggtggaagtgatccggcgtgtcatcgacccggcgaacgttcgtggtcaacgcactaggccgatccggcaggtgtcgaacgccgggggatccacggcagcgcctgcgcggcctccggatcgacgaaggcgaggacggactcgtcgaggcggtgccaggagaggtcaccgtcgccgttctcgtacgcctcacccgcgatgaggagcaggttccgctcgccgatccgcaggaccacctcggccaggacatcggcgtccaggtggacggtgacctcgtcgaccgggccgaccggcagctcgggcaggctccgcgcgcggaagatgccgttcctagaggaggcgccgtcctcgggggaggtcaggagcagcccgaacacatcgtcgtcctggtaggtgccgaccgtcagggcgggaccgtcgagcacctgggcgctcagggtcagcagctgcaggcagggcgcgtcggggccggcgaactcgggtccggcaccgccaccttcacgaacggccatctccacgccgtaccacccggtgacggtccggcccggtacggcgcggaactcggcgatcctggcctgtagccatgcgggcgtcacgaggtcagtgtgcccataccgccgccactgtgagtacggggtggatacgcggcgggggtggactggtcagcgtttcggggtggaggcgacggtggagagggacccggacccggtcggggtcggttgagcagtggcggaggcggccgacggggtgggcgtggtgccggccggcgcggtgacacccgggccggtgacggcgagggcggtgggggacgcggggcgggccgacgatgacgggacccggcccgccgaggacgccgtgggggccggcggcgacgccgaggtgggcagggccgacggtgtgggggagaccgccggggagggcggggcggccggcgggttcgccgggccgttgggtcgcagcagggcgaacgcggtgatcgacacggcggccctagctagctagaggcgctcggggtggcgatcacggtcgcgctcggggtggtggccgggctcgcggtggcggacgcggacgtggccggggaggcgatcacggtaggggaggtcgccggggcgggtttcctgtcgccggcgaaggcggctgctgcggacactccgccgatcgcggcgacggccacggctccggcggtgaccacgagggcccgggtggatctgcgcatctcaagctccagcactgtcggtcggtgcactgtcgcctgggaggacgcctcagcgcaaaaaaggttggcgatcatgatgtgacccgcgacacagtgccggggcggccggtgggcgcggagccgggataatgagcgctgtggagagcttgcgcttcgcccgtgccgaggacggtgtgaccgtcggataccaggtgttcgggcgggggccggcgctggtctggatgccgtcgctgagcaacatcgtggcgcagtggcggattccggtgatgcgggccgcctatcgggggctggccgagcgggtgaccctggtgctctacgacgggcgggggaccggcagctcggaccgccggatcgacctcaccgacctgggggtcgacgcgcacctgcgggacctgcgggcggtcctcgaccacgccgggatcgcccgggcgtcgctgctcggctactaccactcggtgaccaccgcgctggcgttcgcggcccgcgaacccggccgggtcgagcgcctggtgctgttcggcgggtcgccgcggctgcgcgaggcgatgctgccggcccagacccgggcgctgctgtcgttgatcgagcaggactgggacctgttcgccgacgcggcggcggctgcctggctgggctgggatgcggcgccgtcgaaccggtggacggcggaggcgttccgcggggcgacgaccgcgccggtggccaaggcgtggttcgaggcggccggcgagatcgacgtcagcgacgaggtggcccgggtccgggcgccggcgctggtgctgcaccggcagggcgagcagcagatcccggtcgaggtgttccgccggctcgcggccgacctgccggacgcgcggctggtcgagctgcccgggtcgacgccgacgctgttcatggaggatccgggggcggatctgcggctggtcaccgatttcgtggtcggcgggcgggccggcgccttccgggcctcgccggggctgaccgcgcgcgagggggaggtgctggccctgctggcggccggcgagtccaacagcgcgatcgccgggcagctcggaatcgcggtgcacactgtggaacgccacctgggcagcatctatcgcaagatcggggcgcgcggccgggccgacgcggtgcgcctggcggtctcccgccatccgcgctgaccggccgccgccaagtgccgcggccgttggacggcgtacggcgtacggcagtgggtgatgaccgggaccgaggcggcgacccgatgccggcgcgtctggcggttttccgtcatccgcactgacggaacgccgggaagcgccgggcccgtccgcggcggcacgatcggggtatgacaaccgtggctcccagcagcacctcctggcgtttcgcccgggccaccgcgcccgccgtccgggtcctcgccggccgccggctgatcccgctctgggcggtggtgcaccaccgcgggcgggtcagcgggcgcgcgctgaccgtgccgatcgcgctcaccgtggcacccgacgtgttcgtgatcaacctgccctggggtgccaccaccaactgggtccgcaacgtcctggccgcgggcgggtgcgtgatccgttggaagggggccgaccatccggtgcgtgatccgcaggtgatcggcgaggtgcaggcgcggccgtactacgggcgggtggcgtgggcgatcgcccggcgcctgttcccggcggacgagtggctggtggtctcccggcataccgcaaatcccgcccgatagagtgatcgggtgggcgaagggcgggccgcgccgatggcgacgcggcggcccgggggatggtgtcgcggtcggctggtggaacgcgaagagcggccccccgaacctcacaccccactgtggaccgttcccgggccgcgattcagcccgcgcgaaccgggtatccggcgggcatgccatggatcagacgccgccgctacgactactacgacccgtactacgaccggcgttaccgcaacccgcagggctcctgcctgcgcgatgcctgcctgctggagaccggctgctgcatcgccgaaggcctcgacggcaactgcctgatgctgaccctgccgctgctgccccggctgctgacggccaccaccaccggcgggggtggcctgctcggcgggatccgcttctaccagcgggagatcagcgcccaccggccggcggtctgccggttcaccccgagctgctccgagtatgccgcgcaggccatcgagcgtcgcggtgcactgcgcggcgccctgctcgccgcccggcgcctgctgcgctgccggcccggcggcgcccgcggcagcgacccggtgccggcatagccctggtgccgcggcgccgagtgatctgttccacagcggagcccgcaggaattgccgacaaatgacctgctatgttggtgaagttgcagttttgatttccgtagacgttggtcagcgcctgatgggttatcggaaacccatccaggcgcttttcgtttttcggcgtccgggctgcaccgcgcgacctgtcaccacctgctaaggagcagacatgaccaccggcaccgtgaagtggttcaacgccgacaagggcttcggcttcatcagcccggacgacggcggcgccgacgtcttcgcccactattccgccatctcggccggcggctaccgcagcctcgacgagaaccagaaggtggagttcgagatcacccagggtcagaagggcccgcaggcgcagaacatccgcccgctctgatccacgcctgccgacgacggcccgacccatgcggcgggccgtcgtccggcattccgggcgcccgcgcgtcaccgccatgggtaccacggcttcgtcgccacttgactccagccgccggtccgactttcatcggttaccgaccgctacccgcctcgccgccgcgccggcacccgaccatgcgcgtgcgcccgaccgaagaactgaaggacaacaccatgaccacgaactattcaggccccgcgaagctgaccctggtcgacggcgcgtgcatctccggcatggtctccctcagcaccaaccagcgcggcggaatcaccggctggggcggcacgttccgacccgaccagatcacgaccgaactgcgcaacgcgggcgacgggttgcagctggaactgccctacgaccgggtggggacggtcgccgtcaccggcatgcgcaagctgctcgccacgcagctgctgatgtcgttgaccggtcagggccccgcaccgttctgacggagcaccgcaccgcagcgcccgcctgcggacccgccgccaccggggcgccggcgtaggatcggcggcgtgctttcggtgcaggtcagtggccgcgatgacggcccggtgctgctcctgctggccgggcaggccaactcgcacctctggtggaccgggctgcgcgagggcttcgaggaccgccaccgggtggtcaccttcgactggcggggcaccggcgacagccgcggcccggtcggcgactggaccacccggtcgttcgccgacgatgcggcgtccgtgctgcggtcgttgcccggcccggccgacgtctacggcacgtcgatgggcgggcgggtcgcgcagcacctcgcggccgggtatccgggcctggtgcgccggctggtgctggcctgcacctcgcccggcgggccgcaggcgcacgagcgcacccctgaggtccggcgccggctgctggaggcccgcgccggcaccctgcgcgagctgttctacaccgacggctgggacgggcacagccatctgttcggcgaccccacgatgagcgccgaggagagccgcgcccacctgcgggccagcaaccggcacgacgcctgggacgcgctgccccgcgtccgggcgcccaccctgatcctgcacggcaccgacgaccggatggtgccgtcggcgaacgcgccgctgctggccgcccgcatcccgggcgccgtgctgcacctgcacgagggtggccggcacggcttcttcgacgaattcgccggcgagatcacgccgatcatcgatgactttctgggcgactgagcgttcgccgggggcgcgtagcatcgcgaagcgtgaacggggacagcggcggcacatggacatcgccggacggctcgtacatggagcgactgctctgtcaccgccggctgcccctgatcgccggcgtgaacgggagccgcccggcggtgcacgtgtgggagcacggatcgggcgggctccggcagctcggcgtcgtcgacgccggcggtgaaccctatccggccgaagcctggaaacgacaggcactcgtccccgagccggcctggcatccgtccgcggcgcggctggtcgtgaccggcccggccggcccgcacctctggacgccggagggcaccgctccgctgcccgcgtcccggcccggccacgcctaccgcttcgtcgccttcagcccggacgggcgcacgctgtgggcgtcgccgtccgcactgttcgatccggagtcggccggggaacggtcggacgccatcgacctggccaccggcgagctgcggccggggccgaggtgggacaccgccgtcgtcgagcatcccggcggcggactgctggccaccatggtgagcgaccagggcgcgacccacattctgttcgcccggcccggcgcggacccgcccgcgggcctgacgctgttgcgtgatgcgatcatcctcgatgtcgacggctacgagacgccggtgttctccgacgacgggcggtttctggcggtccggggcaacgcctacgttcagtctctcgacgtcttcacgttcccggccatgcgcagggtcctcagcaccaccctcggcgagccgtatccgggttatccgtatccgcccgagtggctggccgagcagcagcgctggtccgcgcacaacatcgccttcgcccccgggaccggcaccctgctggtcggcacggcgcggggcggcatcctcggcatcgatctcgacaccgagcaggtcgccgaagaggagcacagctccgcgccgatcagcgcgctggcgatcacctcgaccggccgcctggtggtcgcggaccgcgccgggcaggtcaccgtgacacagcaccggggccgccggaccggagacagccggccggcgagggcggtcgccgcccggttccgcgcggcgaccgtcgagctgcccgagggcgccgacctggcggaacacctgatccgccacgacggcgagcgggtatgggtgcccggcgacctcggtgacgtgaccgcggccgcggagaccgacccgacctggctccgcctccaggccgccatcaacacggctcagcgccgctgaccaccgcaggcgcgggtcaggccaccagaaggcggaggccgaggtcggcggagtcgagggcgagcaggtcgcggttgcgggccgcccacccaccggaggccaggtcggcgcgcagcgcggtgacggcgcgccgctccgcccgcgggcccacccgggtccagaccgagaccgcgcggcggacccggtcgtcgagataggcctcgggacgccgccagtaggcctcgaacaggccgtcggtgcagtcccacgggatcgggaccggctcggcgcgggcgccgagggcgccggtcagctcggccagggacggccaggcggtcagcagaccgtcgaattccggcaggtagtcacggttcagccagaagtgttgcgagcaggcggcgtcgtacgtcaggacgaccacgcggcgcgccacccgctggagttcccgcaggccggccaccgggtcgggccagtggtgcacggtgctgaccgccatcgcggcgtcgaacgaccggtcggcgaagggcagccggtcggcggtggcggccacgcacggggccgagcccggcggccgcagggagcgcatcaccgcggccggttccaccgcggtgaccgcgaggtcgggcggttcgtaggagccggtgccggcgcccacgttgagcacggtccgggcatcaccgagagccgtccggatccgcgcggcgatccgcgggtcggtgctccgggtggtcggatagtcggcgccgatcatgtcgtacagaagcaaggttcttctccttgtggaagggatcagtcgcggcgcaggacgacgaccagcacgcgcaggacgaggaccaccgcgacgatcagcaacaggtacccgagcaccgggaacaggccgatgccggtggtgacccgcggcccgccggtggtgccgagcagcagggtggccatcaccccggccgcggcgccgatgaccgtgagcaacgtctggtggaccaggccggtgaccacctggcggtcccggtcgtcggagaacaggcggatgttgagccgcagccggccgttctcgatcgcgtcgccgatccggtcgaggcggcgcgggacgccgcgcagcatcggcagcagcgcgatcagctcctcctcgacggtgcgggacaggtttgccggggcgaaggtcgccgccagccggcgcccggccgaggcgcgcgcctgcgcgatcaggtcgaaaccgggccggagcaggcccagcgtgccctccagggtggcgaacgcgcggaagaccgcggccaccgccgccgggatgcccaggccgtacgcggtcagcgtgcgcaccagggcggacaccgcggccaccccggcactgctgcccggcgccgcgtagcggaccagcagcacgcccagcgcccgctgcagatcccgctcgtcgacctcctcggtgtggtcggccaggtcgagcagcgcgtcgctggccgccaccgcgtcaccgcggccgaccgcgccgagcagccggccgaccgcggcgcgggtgatcgcgtcgagccggccgaccgagccgagatccagcatgccgagggcgccgtcgtggtcgacgagcaggttgccggggtgcaggtcggcgtggaagacgccgtgcaccagcacctggtcgagcaggctgtcgagcagcgccgcggcgaccgtctcgcgccggtcggcgcccagccggtcgagcacgggtgcggccgacccgagcggcgtacccggcagccggcgcatcaccaggaccttttccgagcttattgcggcgtacggggtgggcacccgcacgccgcgctccggcgcggtggccagcgccgcggccatcgtctgcagattgtcgcgttcgacggtgaagtccagctcctcgcgcagcgcctcggcgaagcccagcgccagcccgcgcaccccgagcgagcggccccagctcgtgcgggcctccagcgtggccgcgagccgccgcaggatgtccagatcccggtcgacgatcgtggcgatgccgggacgctgcaccttcaccacgaccggggtgccgtccggcagggtggccgcgtgcacctgcgcgaccgaggcggccgcgagcggctcccggtcgatggtcgcgaacacctcgccggccgaacgtcccagctccgcgctgaggaccgcctcgatccgctcccacggcaccggagcggcccggtcctgcagcgcggtcagctcctcgacgaactcggcgggcagcaggtcacgccgggtggacagcagttggcccaccttgacgaaggtgaccccgccctcgtccagcgcggcgcgcaacgaccgggccagccggcggcgggcggcggccgaggtgggcccggtctgccggcggccgcgcaggaaccggcccagaccgtggcgcagcgcgatccggacgatcgccgcatagcgccgggtgcgcacgatccgccggcgggtgccgcgccacagctccaccggaccgggcagggtgccggtcggcagcagcacctcggcgatcaccagggcggccatcgcgatcagcaccgcgacgctggccgcggccagcatcagcaggacgccttgaccggtcgtgacgtgccgggggtcgggcggcgccagggccgccagcagcggcgaggtcaccccggtggccagcaccgcggccagcagcgtgcgacccaggccgacccggacaccgagcagccggcggatgatcgccgcgaaggccagcacggtgaggatcaggaacgggacgaacagcagcaccgagagcacgcaccgaccataggggagaccggtgtcgatgcgcggccccgctcagcggtagctcagcagccgcggctcggtctcggtgtgggtgtgctcgttgaaggtggacagcgacagcccggcccgcccggcgatgatcttggtgacgccggtgttcaccgacacccggttcagcgccgcccagatcgtcgccagggtgttggccggcgcgtccgggccggcggtgagcagggcggcggcgatcgcgatcgggccgcccgagctgaccgcgacgacgtcccggtgctcgcgcagcagggcggcgaccgcggtgagcgcggcggcgacccgggtgcggaacgcggcgaaggactcggcgtactcggcgtcgaaagcaccggaacaccagcgggcggtggcctcgtcgaagatcgcctggaaggcgcggcccggctgctccgaccggttcagctcggccatcatcgcggcccggtcccggaagtgcgggcgatgcacctcgacgacgtgctggaagtcgaactcgttccagttcgcgtcggtcaccaccggcgcgtccaaacccagcccgtccagggtttcccgatgccggcgcatggtgccgcgcagcagcagcgtgggccgcaccccgcgggcggcgagcacccggcccagcgcggcggcctgctcgtgcccccggtcggagagggcgtcgtagtcgtcggcgccgaacgacgcctgaccgtgccggatcagcagaagccgggccacggcgtcacaccatccttcgtacgacggaaagcggaagaagccgcatcgcggcgccgatcggcacccacggccaggccgggacgaacgccttcaaccggcgtttctcgatcgccgcgaccatcgcccgcaccccgaccggggtgtcgaccatgaacctggtcttctgctggacgtgctcgttcatctccgaccggatgtaccccggatagatcaccgacacgtcgacgccgggaatccgctccgaccggacaccctcggcgatcgccgccacgccggccttggtcgccgcgtacgtcgtcatcgatctgcgcatcccgcgcagcgccgacatcgacgagatcagcaccagatggccgccccgctgccggcggaagatctccagcgcggcgtccgcctgggcgagcgcccccacgaagttgaccatcgcggtcgcccggttcgcggcgaaccggccggtgcccagcggcgcgcccttgcccagcccggcgttgaccaccacccggtcgatccggccgaactcggcggcgaactcgccgaacacccgggacaccgcggcgtcgtcggtgacgtccagctgcttgacgaccacccggcggccgggcagctcgtcgcgcagcgccgccagccggtccacccggcgcgcgcacagcgccaggtcgtagccgagcgccgcgaactgcctggccatctcctcgccgaggccggcactggcacccgtgatcaggacgactcctcgtgacatgccgacacggtagggcacgccgtcgcacccgtcgaaaccgcgtcctgatacatccgatcaacgtcggctcccaggacgtcgccgcggccaagggcgacaccttcacctcgatcgcccacctcgacctgggcggcaaccgccactacgggatggtgatgaccggcggcgaaacctccggcccggtccaggccgccgaatgaggagatcgtcaaactcctctcgggaaccggcaacctgtagccgctccccggcacccgcctgacatgatcatgcgacacgtgccggggtgacggaggttcggatggtctggcgaaaattctggcgtacggtcggctcgatccccgggttcaccccgatcgcgaaacgcaccgtgaccctcgaccgctgggtcagccggatcacccgcggccggatcgtggccctcggcatggcccccggcctgctgctcaccaccaccggccggcgcagtggtcagccccgcagctgcccgctgcagtacgtcacggacggcgaggggtacgtggtggtcggctccaactggggcggcccgaacgccccggcatgggtccacaacctgcgcgcgacgccccgcgccaccatcaccatcggcggccgcgacgtgccggtcgacgcgctggaggccgacggcgacgagcgggaacgcctgtggcagttgttcgtggaccagtggccgggctacgcccgataccgcgaccgggccgcccaccgcaccctgcgcatcttccgcctcgtcccggtcaggtaactcacggcacgggccggcgctcagcggtcggcggcgtctgatcgtcatcggtcagggccggatcggcggtccggcgcatcagccgcgaccgcccgacccggtcggtgaagccccaccggcggtagaacggcagcaactccggctggcagaccagctcgacgctgcgcgccgccgccaccgcgggatgccgcagcaccgcgtccatcacgagcgcgcccacgccggtgccgcgatgctccggggcgacgatcacgtccagcaccatcgccagggcgacaccgtcggtcagcacccgggcgaatccggcgaggcggccggagtcacggtccacggcggcgacgaccacgtccgagccggccacgatccgggccacctcgtcgtcggtgcgcccggccgcccaccaggcggtggcgaacagcgccgccagccgggggaccggcgcgtccgcggggcggtaggagatctcgacggtcatcacgccgggtcgccggcgggggtgcggatctccccggccgacatcaggtcgttgtcgccggccgggcgctgggcgagggtgagccttccggtctgtggcatcgacactcccatccggttgtgcagcgcttcgtagccgacccgggtgaccgggctgacccaccgtgtccaccctgccaccgcagtgccgggacgccagggcgccgagcggaccggggccgcaggaccgatcaccgaccggggtgggcggctcacccgaccgggccgctcgccagggccacggtgccggagcgggtccggccggcggtgtccgtccaggacagcttcacccggtcgccggggtggtgccggtccagccgctcgatcagcgcggccgccgagccgacccgggcgccgtcgacggcggtgatcgtgtcgccgcgggcgaggcccgccgaggcggccggcgaaccccgcaccacgctgcgcaccgcggcgccgccggcaccgtcggccgcgccgatccccagatagccggtggcgcccaggtgactgccgtcggaggcctgaccggcctggatctgccggacgatgctcatcgcggcgtcgatcgggatcgcgtagccggcaccgcccgaggccggatagcggaaaccggtcgaggcggcggtgtcgaccccgatcaccgtgccgtcggtggtcagcagcgggccgccggaatcaccgggccggatcgcggcgttcacctcgatcaggtcggtgagctgctcggacgcgccgctcgacgcgtcctgcgcggtgatcgaccggtgcagtgcggcgaccacgccgccgaccgcgccgggggtgccgccggcgccacccgcgttgccgatcgcgacgaccgggtcgccctggcggaccggggtcgactcagcgagcgtggcggtggccaggccggacgctccgtcgaggtggagcacggcgatgtcccgggcgcggtcgtagccgacgacggcggcccggtaagcccggtggtcgccgatgtcggtgaccgtgatggcggtggcgccggcgatcacgtggttgttggtgagcacgatgccgtccgcgccgatcacgatgccggtgccggcggccgcgccgttctgcgcgccgaggacggtgtcgatgtcgaccagggccgggtcgaccttggccgcgaccgcggcgacctgggcgtcggtggccccggctgaggacgaggcgccgtcgccgggatctcggggcaggtgggatcctcgggtgctctgctgcgcgaccggctcgctccgcagaccccaacccgcggcgaacccggccccaccggtgaccatcagcgccgcgagcgcaccggccaccagcgcacccaccggccgtcgccgcggcggcggggccggctgcggccagtactgctgcggcggcatcggcgtgtacggcgactgctcgtgcgggttcacccccattgatgtactccccgatgctggaaaggtcctgacctgttcctgtgcgtacgccacgaaccgtttatcggcgccgcggcgtggtatccggggggacatgggtcgtacacgcaaatcgcttctgatcgtcggaccgctcgcggccggcgtcgtcgtcgccgcaaccgccgtccgccgccgcggtgccgcgccgcccacccgccggcggcacgtcctcacggtctacaaacccctgtccgagttggagagcacgcagctgcccggctcgctgcgcgagatcgccgaccgggtcgagatctcgctggcggccgcacccggcggccgcggcaccgagatcgcggtccgcatcccggacggctccccggtcaccgacggcgacgtccgccgcgccctgcgcgaaacccgctccctgatcgaggccggtgacgtgctgctgccgtccggcccggccaccaccacgccgacgctgctgaaccggccgctgcaggcggccacccgcaacggccgcgaaggaggcctgctgtgaaggcgctgcagtgggagggtgtgaacaagctcgccgtcggcaccgtgcccgacccggagctgcgcaacccgggcgacatcatcgtgaaggtcgccaagaccgtcacctgcggctccgacctgcacctgctcggcgggtacatcccgttcatgcagaagggcgacgtgctcgggcacgaattcctcggcgaggtcgtcgagatcggcccggacgtgcgcaaccaccgggtcggcgaccgggtcgtggtgtcgtcgttcatcgcctgcggcaactgctggtactgcgaccagaagctctactcgctgtgcgacaacggcaacaccaacccggcgatcaccgaaaccctgtgggggcacgcgcccagcggctgcttcggctactcgcacgcgatgggcggcaacgccggcagccacgccgaatacatccgggtgccgttcgccgacgtcggcgcgttcaccgtcccggaagcggtcagcgacgagcgcgcgctgttcgcctccgacacggccgccaccggctggatgggcgccgacctggccggggtcgccccgggcgacgtggtcgcggtgtggggcgccggggcggtcgggcagatggcggcccgcgccgccgtgctgctcggcgccgaccgggtggtcgtcatcgaccggctcgagaaccggctgcggcaggtccggcagcacatcggcgcggagaccctgaactacgagcagaccgacatcgccggcgaactgcgcgagctcagcggcggccgcggcccggacgtgtgcatcgaggcggtcggcatggaggcgcacgcgcccggcccgcacttcgcctacgaccagctcaaacagcagctgcggctgcagaccgaccggccgatcgcggtccgcgaggcgatccacgcctgccgcaagggcggctcggtgttcgtcctcggcgtctacgccggtttcgtcgacaagtttccgctgggtgcgttgatgaacaagggattgacggtacgcggcgcccagatgcacgggcagcgctacatcccgatgctgctggaccggatggccacgggtgagctcaccaccgaacacctggccacccatgtgatgccgctggaccgggcgcccgagggctaccagatcttcaaggacaagaaggacgactgcgtacgcgcggtgttcgtgccctgatcccgggctcttcctcccggccgggtgatccacgatggacacccggccgggatctgatagtgtccggctcgatcgtgaccccgtcgaggaggtgagacccatgaccgcagtaaccacgtgggtgctcccctcgccgtcacgatcaggcgattgagctgaggattgccgggagccccgaccgccatcggaaggcaacccgtcatgcactcgctccacttcaccgcccagaccaccgccgacggcgtcctcgaacgcgacttcctcgtcggtgacatccccggcgtcctctggtcaccggccggcgacgccggtcccggcccgctgatcctcatgggtcacggcggtggcctgcacaagaagacccccgcccaggcggcccgggcccgcgacctggtcaccgcccacggtttccgggtcgccgcgatcgacgcccccggccacggcgaccgcccccgcggccccgaggacgaccgggcccgcgccgccttcgcctccggcgacccgtcgctgttccggtcggccagcgtccgctacggcatccacctggccgcccaggcggttcccgagtggcagcagaccctggacgcgctgcaacagctgccggagatcggcccggacgcgccgatcggttacggcggcggcatcaccctgggcaccgcgatcggcctccagctgaccgcggcagatccccggatcagggccgccgtcttcggcagcggcttcttcgtgtacgacgcggcccggcaagccgcgcgccggatcaccgtcccggtccagttcctgatgccgtgggacgacgaacacgtcacccgggccgaggccctggagctgttcgacgcgttcgccagcccggagaagaccctgcacgccaacccgggcgaccaccggcggatccggtggtacggcctcgaccacgacttcctgccccgccacctgaagtgaggcccggcccgcctgatcagtcctcgtcgaggccgagcaggcgggccaccagggcgacctggtcggcgtagtgttcgacgaactcgggggagcgcgggtccgccccgcacaacccctcgatcacgtgcggcagcgtcgtggtggccatgctggcggccatcagcatgatctgcaggcagaccgggtcgatctcggccggcagccggcccgcctcctggagccggcgcaggtgggtgacgctgccgccgagcatctgggtgcgggagtcccggtccgggtcgtcgtcggggccggtgtactgcaggccgctccaggcgaacatccggacaccgtccgggttgtgcacgatctccatggcgtaccggcggagctgttcgggcatcggggtgccgtccggggcgaggtcgtcgcggcgctgccgccactggtcggacatggcccggtagaggccttccttgccgccgaagtagtacgacaccagttgctggttgacgccggcgcgggcggcgatggcccgggtgcgggcgccggcgtagccgtggtcggcgaactcgacggcggccgcctccagaatcttccggcgggtgcgttccgggtctcgccggcgttcctgaggcgggggtgacctgcgcggacgtggtgatgtcacagacggaccctacaccggatcaatcaatcacatgattgacaaagacatgcgggcgcttgataccgtgtcgggcatgacgaaaatcctgatcagcggcgccggtctcggtggtctcgcgctcgcccaggccctgcaccgcggcggcttcgaggtcgccgtccacgagcgtgaccccggtccgcagacccgcggtcagggctaccgcctgcacatcgacgcggatggcaacgccgccctgcgcgactgtctgccgcccgccgtcctcgatctggttcgggacaccagcggtgtcaccggcgacctggtcgccaccctgacccccgacctgcggcgggtgttcgcccaggagttccccggcatcccggacacggagatcaccaacgtcgatcgggagacgttccgccgcggcctgctcaccggtgtgaccgacctcgtccacttcggccacaccgtggccgactaccgggtcaccgaggccggccgggtccgggtgacgttcgccgagggcggcaccgacgagggcgatctgctggtgggtgcggacggggccggctcggcggtgcgcgcccggctgctccccggcgccgcgccgcgcgatctcgggctgcgctgccgatacggccggatgccgatcgacgccaccaccggcccgctgatcccggccgatttccgccgcgggttctgctgggtgaccgggagcgggggctggggcgccggcttcgcgccggtggtctaccgggacggccgccccggctacctgatgatcgcgctggtcggcccggccggcaccggtcaacccgacgactggcatccgaaaattcagcagcttctttcgtacgccgatggctcctccttcttccccatcaccatccgagcgagcgtccgcaccgacccgtgggcgcccggtccggtgaccctgctcggtgatgccgtgcacaccatgccgccggccgggggagtgggcgccaacaccgccctgcaggacgccgcgaccctggccgccgagctgctgtccggcaggccactacccgacgcggtcgccgcctacgagcgggtgatgattccccggggatacgacaccgtggagcggtccgtccagatgatcacccagatgtccggagccacccactcctgaaacgcggcagcgtgttagccccgcctccacagggtgtcgggcgcagggaggcccgtcgatgcgtacctgactgatccggatcggatcctggtggtacgtcgggctgcggatcgtcgtccgctgtcgggtcaccgccatgggggtgccggctgtgccgcagcgccacgacggcagccggtgcggcgtccgggtcctcgggtgaagggagctcgaccatgtcgtcgtcaatcgctgacgacgtcgatcaccctgccgccgagcccggaccgggacgtgggccggccgaccggttcgacgagaacgtcgccccggcaaccgtcgccgaaaacggcggtgatggcctcggcgagcgcggcgaccaggtgtgcggcgacggtggccgcgtccggtcgggcgaacacttcctcgcgcatgccgaacgtgaccgagggtgcagccgtcgcgaccgccgctccgccgcgagcccaccgtccggccgggatgccgaccagcttgacgtccactgagctgcggacccgttcgccgtaaacggatacgacggcggtggtcagtttcgcgatgagggccggttcatggctggccagctcgtgttcgagtgcatggatcgtcacgtggggcatcggccccacctcggtgtcagcaacggcggctggcagcgtgccatcggcgcaggataggaccgttcatacgcggcgggaagcgatttcccgtcgtccgctccggcggtgggttcaccgatcgcagcgacggtgcgacgatgtccggcggttccgtgccatggtcggtcaccggggcggccgctgccggctcacgatgcgaggcggtcagcccaggccagcagtccaggatcggtcaacgacgcgtacgaccggtgggctttgagggtggtgcccgggaccgatggcacgccgatcacgaagaggccggcggcgctggcggaggcgacgccggtcgccgagtcctcgaaggccacgcagcgggccgggtcggcgccgaggcccgcgcaggccgccaggtagaggtcgggtgccggtttgccgtgttcgacgtcgccgaccgcatacacgtacttgaacaggtcggccaggccggaagtgatcagcgcggcgtcgacgaaggcgcgcgggctgttgctggcgaccgcgatcgggacccggcccagcagcgactcgaccaggttccgggcccccggtagcggctccgcgcccgtcgccaattcctgcgcgaccagggcggagagtcgtgccgccagggccgggccgctgccgggcagaccgaagtggtcggccatcacctcgccggcggccggcagcgtcttgccgatcagcaggttcttctgctccggcccgaagccgtggccgtgctcggcgaacagggtcgtctcggcgcgtgtccagcaggtctcgctgtcgacgagcaggccgtcgcagtcgaagatgatggccgcggcgtcgttcggaagatccacaccgtcacggtacccggtacggcggcgccaccccccagccccagtgcggcaccggcgcctgtcgtggtggtgcggcgccgggctgcgagttggccagggccagtcgggtgccccactcgatgtagcccatgaacgcggcccggaactccgggtcgtcgggcagcccgacctcgtcggcggcgtccacgagcagcgccacccagcggcggcgttgctgctcggtgatcgcccgcccgaggtgtttgcccagcatgtgggcgtatccgccgcgcgagtcggtgtacgcggaggggccgccgaacacttcggacagccacatcgccacatatctcgggtgggacgggtccatgtgggcgaacagcgggccgatcgtgtcgtcggcgaggacccgggtgtagaaggctgcggtgagccgttcgaaggccgccgcgccgccggcccactcgtacatcgtcggcaccgagcccccggtgccgtgcaccccggtcacctcgtagtgccgcatttcttcgatgtcgtcgacgtagggccggatctcggccagaaaaccggggaagagctcgccgccccggaatcccttcagatgatcttcggccgatgtccaggtgatccgcagcaggtatgccgccggctcgtcgacgcagcggctcaactcgtagtcgacgcactgcggggcggccgccagctgcacggccgcccgctggtacgcctgctcgaacccggcggcccggtcagcatcgacccggtagcggaggtattcgacgatcatgacgcacccgtgcccgtaatcatgtaatcaagtaatacacgcttagtcggtatctgtcgacggcaggtacgcccccggcacccgatcgggcgcgacgatcgtcgcctcccccgggtacggcttggtccagttgtgcgtctgataccaggtgaagtggttcatctgcgccgggttggcgaagtcaggcaccgcgtccggaccggtcagccgctgccgggacttccacgcctcccactgcgcgaccagcggggtgaccgccgccgggacggccgccgcgggggctgccgccaccggggtgtccgcaccgcacggcggcggcgtcgacaggcccagggtcagcgaggtgcggttcggcagcgcggtgaacggcgtgaagtccggccgcccggtgaacgcggtgaccatcggcgtggccgcgctgtccttctggttcatcgggtggaccccgaggatctgctcgatcgtgcggatcatcgtgatctgcgagtagtaccggctgtccaccacaccgtgccgcgcgtacgggctgatgacctggatcggcgcccgatgcccgtcgacgtggtccagcccggcctgcgagtcgtcctcgaccacgaagatcgccgagtccttccagtacttcgagtgcgagatggtgtcgaccatcttcccgaccgcgagatcgttgtcggcgacctgcgcggcggcgctcggcgggccaccggtgtggtcgctggacagccagaacatgttcaggttcgccgggccgttgtgctcgaagtcccgcttccagatctcgtaccggtagatgtccggcaccgcggtgtcgaacttcgggaagccgggcaccgacacgctgttcagcgacgggatcggcgaggacgacacgaggtggtacgccgtgtccgcccccgcggcgctcatggtcttcgcgtcgcagtacaggttctgccaggtcgcatcggccggcttggtgaggaactggtggaattcgccgaagtcgcgcaccgtcctgccggccgcctgcgcgccggtccagatgaacccggtccgctggtgacccagtgcatcgtcctcggtgtcgtagctgcgcgtgtactcgccggccgaggactcggtgtactccgggtcgtcggcctgcatcagccagttgtgcccttcggccgagttggtgccgatgtcgtaggtgttgtcgtacagcccgaactgccgttcgagcgcgtgctggttcggcgtcacggtctcgccgaactcggccaccgcagggtcaccgtccgcccgtggctcgtcgccgaacatctggtcgtacgtccggttctccttgacgatcaggaacacgtgtttgatcgtcgacgggtcgccgagccgcgccggcaccggcgtcgcccgcacgcgtccccgtttcggggcctcgaccaccgagcccggggtccagccgttctgccggaagaccttggcggtgtacgccttgatcacccgatccgcgggcagcgcgaaccgctgcaggctggacgtggtgtcgtggctgccgtgcccggccgcggtggtgggccgccgcgcgtcgatgccccgggtgttggccaccagcacctgcccgccgaccgtcgcgatctcggccgggaagtagtcggtcggcagcagccccacgtagctgaccggctcctgtgccccgcggaaccggtagaccgcgacggcgttcgcccgtcccagggtgaccagcaggtgcccgtcgccggtcagggtcaccgcatccggctcgtacccgaccgacgcctccggccagggctgcgtggcgatcgtctgcaccaccgcgtcccgggcggtgtcgatcaccgagacgtcgttggtggcggtgttggtgacgaacagcgtgctgccgtgcgcgtacaccgcggtcgggtgcagccccacggtgatgctgccgaccgccgcgtccggatccgccacgttgatcacgctgaccgtgccggtcgtcgtcgcgccggtcaccggattggccggcacctgcgtgtcgtaagagttcagcgtggtgtcgccggtgaccgcggtgcgcccgccctcgttgctgacgtacagcttggacccgaccagcgccaggtcccgcggcgcgttgccggttgcccagctccgggtgatcgcaccggtcgccgcgtcgatcgcgaccacccggttctgcccgttgaccgcggcgtacacggtagcgccgtccgcgctgaacacggcctgcccggccagggccttcttcgtcgcgtcggtggggatcgggacgaacgccgggtcggcgagcgtgccgtcgtcgtgcacggtgaatctgcggtatccggtcgcctgggcaagccacagctgtctgccgtcgggggagtaggtgggaccctcctgcccgacgtcgttaccgctgatcttcaggtcggcggccgcgttgttgccgatcagctgctgcacccgccacgtcgtgaggtcgacgacggccagcgccatcccgccgtcggtgatcgacgcggccacgtgcgtgccgtccgggctcaccaccgcggacatgatcttgcccttgtcgatgaccaggcgcttgccgatcgggtcgatgtactgatcggcggagaccacctgccccttcgcggtgacctgtccgacctggtcgtgaccgaacgggagggtcgacccgtaggccaccccggccccggccagcacgaccgtcgcggtcgtcccggcggtcaccgcgaaccaccggccggacctctgtctcacctgcctgcggcgctgtacctgcatagtcgctatcccttcggaagcagctcgacgatgccgtcgaactgccagagcggattcggtgcgtcgccgttgtcggtgcgcacgacgaaatagccgttcacctctttcgggccgtcgccgtccgcgacataccgcccgtccgtggcgacatccagctggtagacggcctgacccacagcggtcacctcgggcagatgccaggagacgacgcagcgccagtcgttgcccggcccctccgcgtcgaccagaccgccgcccttcgtgcacgccgcggccgcctgcaactgcgcctcggtcacgtccggccggtgcaactgcccggcctgcagccgatagagacgggcgaaagtggtcgccaccgaggactccacccgcgcctgggtgatcccggtcccggtcgagccgggcaccgtgacgagcaacagcccgaccgtcgccaccgccagaccggccagcggcagggcgccatcgaccagcgcgcggcggcccgagccgtcgtacgccgcaggggtgaagtcccggcgcacgaagatccggtaggccagagcggtggccgcggccgcccacagcagactgaccgcgacgctgatcagaagcggaccgagctcgcgcgggctggtgaacaggccgtgccagctgaggaacgcgtgaatgggcaacgccaggcgcaccgccaccggcagcggcagcatctgcgccacctgcatgcccagccccaccatcgcgggcagcagcagccccatcgggttgcggccgagtgccaccgaaccgagcagcccgatcgcggccagcgccagggtcggggcaagggcagaaatccaggacaggattgccggtacgccggcggaccccgccgtcagcacctgcccatcgagtccgatcagcgggtggtcacccaccgcgagcagcccgcccaccgtgctggacacggccagccccgccaccagcagcacgatcaccgtcaggccggccagcgtcttggccacgaagatccgccgcggtgaccgcaccgtgaccagcagatgccgccaggtccccagccggtcctccaccgcgaacacgtcgcccgcggccggcgccgccagcagcggcagcccccacgtgccggcgaacccgagcatgaccagcggactcgcccacccggtcgcgagcatccaccgcccgaacagcgtgtccaccggcaacgtcgtctgctgaccgacccccgccacgaacaacccgggcgcgatccagcaggccaggaccagtagccggatgcgccactgcgccccgagcttcaccagctcgaaccgatacccccgccgcaccggcaccggcaccggtcgctcgccggtccgttgcgggtccggtgcgatgccggcggtcatgccgcggctgcttcggtgagtgacaggaaggcggcttccagcggcgacacggccggggtcagctcgcgcaccgcgatgccggcccgcaccagccgcaccaccaggtcgtccagtgccggaaggagcgcccggatcaccaggtccccggtgaccgcgacccccggcgtgtccccggccacccgccgggccccggccggatccgaggtgaccaggcgatactccagctcgcgatgctcggcggccagcttggccagcggccccgagaacaccacccgccccaggttcagaatggtgacctcggagcagaacgcctccacttcgtccatccgatggctggacaggatcaccccggtcccgtccgcggccatccgttggagcaccccgtgcacctgccgtttgccggccgggtcgagcccgttggacggctcgtccagcaccagcagccgtggcctggtcaccagcgccgccgccagtcccagccgctgccgcatcccgagcgagaacgtccccgcccgatcatcggccacctcggccagtcccacctggccgagcacctcatcgaggtccgcttcccgtgccaccgccccggcccggacacgaccggtgcggcccccggaaacctgaccccgcagcgcggccagcgcctccagattctgccgcgcggtcagcgacggatagagcccgggcccatccacgaaccccgccaccccatccggccccgccagcgcccgccgaaccggcaccccgagaatctccagcgtcccgccgtccggcacagccagccccagcagcagcccgagcagcgtcgtcttccccgccccgttcggccccaccagcccgtgaatctgtccacgcccaagatccaggtcaacgccgtcgagtgcgacaacctccccgaagcgcttggtgacaccccgggcccggatcgcatgcagtgccggcataagtccctctttcgtgaccttcgatggaatctaggggccaccggttatagccgggttaacgtcagacgaaagccatccgtctgggtcaatgccctagatctctccggagcccactacggtctcccggccggcgcgcacggcttcgggtcccgattagccgctcgccggttccgggtcgtagctggccgcgaacgctttcgcgtcgtagctggccgcgcacgccttcaggtcgcggtcggccgcttgctggctctgggttgcggtcggccgcttgctggctctgggttgcggttggccgcttgctggttccgggtggccgcttgccggctccgggtcgggggtggccgctcgccggttccggtcgcggccggccgcttgtgccgtggccggccacccgcactgccggcaggtaggcaacggcgtaccgactggagcacgccgcggagaggcgctgggcaagaagcgtgtggctcccccgatggtgggaagcctggggattcgcaggcgcctggttggtcagccgggcaagcccgaacgatgaaaccggggcggtgaacccggtagtggcagggccgggaggcggctggacggatcggcgggccgggaggcggctggacggatcggcgggccgggaggcggctggacggatcggcgggccgggaggcggcgggacggatcggcgggccgggaggcagcaggcccggaggcggcgggacggatcggcggaaatggaggcggtagacccgagggcggtgggtcgggccgcggaggaccgggagcggtgacgagggtggtcggtgggtgtcaggcgggattgcctagccaggtggtcaggtggtggcggaggtcggtcgtgggggaaccggaagaggcccaggcgacgtagccgtcggggcggatgagtgcggcggtgaggtcggaggtggcggctttggccgagtggacggtgaggcggtcggcgtagccggtggccagggcggggaggtcggggtcgtcggcgaggtcgaccagcagggcgcgaccggagtggaggtggtcggggagtcgggtgccgtcgtcgaacgtgaggtcgggggcgctgcggccggtcagcggatggtcgccgggcaggtcgtagccctgccagacgccggagatgcgtttggccagccaggtggtggcgtcgacggtggaggtgagaccctgaaggacaccgcgaatggcgcgggagtgctggtcggggcgcatgatcgcgatctgggcacgggtccagtcgaggatctgggcgccgatcgggtggcgctccgcggtgtacgtgtccagcagcccgtcgggggcccaaccccggatggtggcggccagtttccagcccaggttcatcgcgtcgccgagccccaggttgatgccctgaccaccgaatggtgagtggacgtgggcggcgtctccggcgagcagcacccggcccgaccgatacgtaccggcctggcgggcgttgtcggtgaaccgggtgaccgagctgatccccgtgacggtcacgtccacgccggtgacccggcggatcgctccctgcagttcgtcgacggtgaccgggctggtgcggtcggccggggcgccgtcgaactcggcgaccaggatgcggccggggaacgggccgaacgtgtagaccccggtgtcggtgatgtgccaacccggacgcaggccctcggtgccgatcatgtcggcgatcgcctggtaggcggtgatctccggatcggtgcccgggaatgcgaaaccggccagtttgcggaccgtgctgcggccgccgtcgcaccccgcgagccaaccggcctcgatgaggccctggtcggtggtgacgacgacgccgtcggcgtgttgctcgaagtcggtcagggtgacgccacggcgcacctcggcgccgagcgcccgggcgcgctcctcgaggatgacctccagctgctgctggctgaccatgccgagcgcgctgaaccggccgccggcggcgatgtccggatcgtcggggtcgagaagctggccgtcgagcatcatgccaccgaagtggccgatgaatcggggcatcttctgctggactgggccccggccggcgaagcccatgcgggccagcgtctcgtcgcgggcccgctcgatcgcgggcgacaggccgcgccggtcgagggcctggatgccgggcacggtgatgtagccggccttgaccgtcaggtcgatctcggtgtttcgctccagcaccaccacagtgaccccggccagtcgcagctcacaggcgagcagcaggcccaccgggcccgccccggccactacgacgtcggtcatcgtcgtcccccgtcctccccttttcactgtcaccagaaaagtactgccactaaaaggttctagcaagtaaacttttgctgtgaccgaaatgggactgcgggagcgcaagaagcgccagacccgcgagctgatctccggcgtggcgacggagatgttcgtccagcggggcttcgacctggtgaccgtcgccgaggtggccgccgcggccggcgtctcggagaagacggtgttcaactacttcccgcgcaaggaggacctgttcctcgaccggttgcccgagctgctcgcgctgaccaccgaggcggtccgcaaccgtccggaggggacgagtgtgctcgccgccttccggggtgtcgtgttcgacctgctggccgccggtcacccgttgagcgcctacccgggtcgggggcacgccgggttctaccgggtggtggtcggttcaccggcgctgcaggcacgggtccgtgagttccagcaggagttggaggatctgttggtcgagctcgcccgggagagcagcgggaggggcgggggcgagggggaactgcggctccggctggccgcggcggtcaccgtcgccgcctaccggacggtctacttccgggccgccgctcgcgtgctggccggcgaagatcccgtggcggtcggtgaaaccctcttcgcggagtacgcggagaccttcgccgccgcggagaaagcactgagctgaggagcgacggaccaccggggcgggatagaagcgtgctggtgcgggagggtgccggccggcggtcgaggggaggcgccggagcggggttgaggcggtgcggtgcggtgcggtggggtgccgggccggtggtcgaggggaggtactggtgccggcccggcggtcgaggggaggcgccggggcgggagggtgccgaaagtcgtcccattcgaatccctgggtgaacgcaaagggagggctgcggagggcgcgggccggtgccggtcaggctcgggcgatgtcgagggtgcccaggccggcggtggcggtgatgtcgagggcggggccggcggtgaagtcaccggagcgcagggtggcgccggcgccgatgccgccctgatggttgccgtagaaggcgatgtcgccggcgccctgcccgactgtcaccttgaccggtatctcgccggcggtgcggatctgccaggtgctcaccccgcccgccatccggatcggcagggttgcggccaggcggccgagggtgatgtcgatgcgttcggcgccgccgttcaggtcgatgcggctgatcgtgcccgcgcctaggttcagggtgaccgatttggtgccggcgccgatccgcaggcgccacacccgctggtcgctcaactggacctcgaccgggccggagccgtcgccgttgccgctgagccgcagcacgccgtcgtcgaaggcgctgtccgccggtccgctgaccttgaagtcgccgtccagccgggcggtgcggaccgaaaggtcggtgactccggtgaccagttcgaaccgggcggcggccgtggtccggaccgggatcaccgggatgctgggcgcatggctcggcgcgacggacgacggggtgggcctgggttcgagcggaatgaccacctgactcggcaggggcggcacgacgggcgccgcgcgctgatggatgtccgagttggtgagtgggcgggcgagcaataccgatccgatgatgaccagcagcgcgaggaccccggcgaggatgaccggccgacggcgccggcgccgggacgagggagacgaatccggaatgtcgctaccgcggccggtagccggccgccggtcaggatggcggctgccggcgctgtggtcgccgcccccgcccgggagtgggccctgccggcgacccgcacccgggagcagaccctgccagccggctttccggcggccgggggcatccggccagtagtcggcgatgttcggcaggcgccgatcgaatgaggcggtagccgtcgacgcggtggcaggcagcgtggacctggtggcggtcgacgtcgctgtggtggcaggcagcgtggacccggtggcggtcgacgtcgctgtggtggcaggcagcgtggacccggtggcggtcgacgtcgctgtggtggcaggcagcgtggacccggtggctgctgacgtcgctgtggtggcaggcagcctggccccggtggctgctgacgtcgctgcggtggcggacgacgtcgatgtgtcagccgccgacgtgggcccggccgcggacgacgtgggcggagcaccggccggcggggatggtgcatcgcctgacgccgatgcagtcccggttgacgccgatgcggtcagtggtggcgcggacggtgccgggctgtccaggtaacgggcgatccgcagccgggtttcctcccggccggcctgctccacacacgtctcctcggggcgccgcactgttttcccgaggacggtaccgtctcgttgacgcctcgccaacagggatcacccccgggcgcggacctgtcccacgatcgcgttgaaggcgacgtcctcgatcgacggccggggctgcgacgcctcctgcggccaccactcggacaccgactgcacgccgggctccagcaggtcgagccgctggaagagtttgccgagctgctcgccggtgcgggcgcggaaccggccgtcggcgttggcggcctccagcgcggcgatcgcgtcggccggcagatactcccacgtggagtgggaggcgaccacatagctgccgggcggcagcgcgtccaggatggtgtcgaccacgccctgcgggtcctcgtcgtcgcggatgaagtgcagcaccgcgaccatcatgaccgcgatcggccggtcccagtcgagggtggcgcgcacctccgggtcgtcgaggatggtgcgcgggtcgcgcaggtcggcgtcgatgtaggcggtgacgccctcgggggtgctggtgagcagcgcccgggcgtgggtgagcacgatcgggtcgttgtcgacgtagacgatccgggcggccgggtcgatccgctgggcgacctcgtgcgtgttgtccgcggtcgggatgccggtgccgatgtcgaggaactgccggatgccgcgctcggccaggaacttgacggcccgctgcaggaacgcccggttctccagggcggccagccggatggccggcatcgctttctcgatcgcctcggccgaggcccggtcggcggcgaagttgtccttgccgccgagcaggtagttgtagcgccgggccgggtgcgccaccgtggtgtcgatccgatccaatgcgctgcgccggtcgctcacgacgtctccccacgaaccacgaagcctcaccgaagatccgcaagcatcgtagtacgtcacctcgggtccgaaacggacagcggcgtggagacgggtcaggcgaaccgggcgtgcatctccaccagcagttcgccggtgcgtccgtggaaggtgtccagcgccgtggcgaacgtgtcggccagcgcccgcgccgggtccgggtcggcggtgttgaagatcgtgatcaccgccatcggtgcacggtcgatgcgttctcgcaggtcggcccgctgctcctcggtgagccggtcttccagccggtccagcggcaggccggtcgccgcggtcaccagcgccgccgcggagatcagccggaacaccgcccgccggtccgggaacggcagcggcgccccgcgatcgagcgcctccagcgcgggccgcgcccagtccagggtgtccagcccggccacctcgaacgcccgccgcgccagccaccgggtcacccgccgctgcttatccgggtcccaggtggcgaactgtttggccaccgccgcgtacgccgaggacaccgccgggctcggggccggcatcaccggccggggcggcgcgtcccgcagtgcccgctgggcgcaccgccgcagcaccgtcgcctgcaggctgcgatcgctgtcccggatcgcgtacgcggtcccgaaccggtccccatcggcggggaaagccgccgcggcgatgtcccgcaccgcgttcatcacctgcggatcgtcgcgttcgtgcaggtcccgcagccgggcccggagttccggcgccggttcacgtccggcttccagagctttcagcgtctcccgcaccgcgggttcgccgatcagcccggcgtcctcggcgatcagtcgcgcccggaacgcggccatcgccggcacgttcgccgcggtcggttcggcgagcatccgccgcaggaacggatggtcgagcgcggccaggccgcgcccgccctccgggacgagatcgtcgggcaccggagtcaacaccacgccgggcagatcccggtccagaagatcgggaggcagccgtacgccggtgagccgctccgccagggccagaccggccgcctcgggaatgatgtcgtcctggtggccgaagggcagccggccgacgtgttcgtcgagcagccccggctcctccccggaccgccgctgcggccgcacctggtccagcaccaccatcgtgcgcccgtcgcggaccagcgtgaactcggagcggccgcggacgtcccggaagacgctgagcgccgtgccgtcgccggcctcggccgcccggcgcagcacctccggccggttgccctggccgccgttgacctcgatgccgaaccgccacccgccgaggctggtgacgaccagggtggccggttccgcgccgtgcgggaacgtgtccaggatctgggcgagctcggcctgcggcagcacggccgccgggtcgccgccgaacgcggtgatcaggtcggcctcggccaggccgcggaccatggtcaggcagaacgcctcgccccactccgcgtccaccagcatccggtcgtagtactcggccgcctcgtcacccacccggtcaccgtacgatcaacggccgcgccccggagccgattcctgacgacgctcgcccgacagcgtggcggatccgggtgggaccgcgcaccgcgccggacgcattccgctatggtcgacggttccattccggcacgattgccgccgcgcaccccggccgcccgcaccggatcggcccgtattccggtccaccaatcggtggcttttctgttctccttttggtgaataggcaggatccgcgccgctgtgacagcctttttcctgtgacggtgcgccgggtgacgctcgcggagatcctctccttctaccgtcccgcggtcggcggtgacacgtgggagcaggccatccccgatctgctggccgaccccgacgacgcccggatcgtcgacctgctccggtccgaactcgtcgcgcacggcgatttcgccgaaccgatcgtcgtcgaccagcaggaccgcgacattctcaacgggatgcaccggatcgccgccgcggtgctgaatcggcagtcggcgctggacgtcgccgacacctacgcggatctgccggagaaacggcgggttctcgtggttctcggcgccgaggcgctcagcgccgcggtcgtggaccggctgaccaaggtgctgtggtcgttcccgttcgccggtggctggaccaactgtgacgtgatgttccccggtgacggtcgggtctccggctggtggcactgcccggacgggagggaccgggcgctcggcgacgagctggtgatccgcgccgccgaggccgggatccggctgaccgtggagtcgatcaccgaggtgaccggggccgatccggggtgacggtcagccgatccgcaggcgttcgcacagggcacgcagctcggtgccgccggccgcccggcgcgaccggtccagcagtgcccgcgcggtctcctggaccagcgacgacgtgtgcacgtgctgcggcgccacccgttccgcggtgagcaggaaccggatcgcctcccggtcccggtgacgcagccgggtcagggcgcgcgccgtgtcggcatagaagaacacctgccggaacccgaccggcagcaccgccggatcggtctcccgggcgatcgccaccgcccggcccggctcgtcgccgtcggattcgatgccgacccgccacacgttcacgttggtcgggccgaagtacaggccgagcgtggtggtctccccggtgcgggcggccagcgcggcggcctcggtgagccaggcccggctgtcgtcggagcgtttccggccgcggctgctgtccgcgcagatcagctgcagcgagccggtcatctccggccagccggcccgggccgcgtgcgggcgcagctcgtccaccgcctgcgcggcgagcgtgtacgcgcggtcgtaggagccgcacgcgccggccgcggcggctcgcgaataaccggcgtacccccgcaggatcggatcccgcgccgcctcggccgcgtcccggcagcgttccgcgcccagccatgcctcggccggatggccgagattgcgcagcaccgacgaggcgatgaaggtgacctcgcagagcagccgcagggcggccggccgctgctcggagccggtcgcggcgtgcaggccgcggagcagcccgggcagcagccgtccggcgccggcgtagtcgcaggcctgccgcagcgtgtccagcagcgcggccgtccgggtcagttccgggagcgacgggagtgccggaagtgaggcaggcgtcgcggtcaggtccaggtcgaccagggcctggcggacggcgtgcacggcggcgtgcgcggcgaccgcctcccgatccccggccggcaccgccgtcccggccagctcggcgggggaacagtccagggcggcggccagatcggcgagcatgaaccggttgtcggcggcctgccggccgcgctcgatccggctccaggtggcgtgtgagacaccggcacggctcgcggcgaaccggatgctccagccacgccgcaggcggcggtcccggatccggtcgccgatcgccgggtcggcggagggtcgaggcgtcatgccccgacgctaggcgggcatgcaccgcggtgcggtacatgcccgtaccggtcagtgcgggccgaccgcgacgatccggatcgccgcgccgccgatctcgtcggactcggcgaggtcgatcgtggcgtcgatgccccagtcccggtcgccggccgggtcctcgaagacctgccggacgctccacatcgccgggctcgtctcgatctgcaggaactgcgggccgcgcgccgacgagccgatgcccagctcgtcgtactcgtcgaagtagctctcgatcgcgtcccgccaccggtccgtggtccagccggaggtctcgccgtccagctcgccgagctcggcgtagcggcccagggcggccagctcgacccggcggaacagggcgttgcggaccagcaccttgaacgcgcgcacgttgcgggtgaccgcgggcggcttgtcgtcgatccgcacctcctcgatcaccgcgcccgggttgcgcagccgctcccactcgtcgagcaggctggagtcgacctggcggaccagctcgccgagccactcgatcaggtcgcccaactcctcggtgcgggcgtcctccggtacggtctggcgcagcgcccggtacgcgtcggccaggtagcgcagcaccagcccctccgagcgggacagcccgtagaaggagatgtactcggtgaacgtcatggcccgctcgtacatgtcgcggaccacggacttcggcttgatctcgtagtcgccgacccacgggtggccgcgccggtacgtctcgtacgcgccctccagcagctccagcaacggctgcggccaggtcacgtcctcgagcagcgccatccgctcctcgtactcgatgccctcggccttcatcgcgttgaccgcctcgccgcgcgccttctgccgttgcgcggagaccacctggcgcgggtcctccagggtcgcctcgatcaccgagaccacgtctaacggatactccggggcctccctgtccagcagctccaggcaggccagcgcgaacggggacagcgcctggttcagcgcgaagtccagctgcaggtcgtcgaccagcttgtagacgccctcgtcggtacgttccaggacgccgccggcgatcagcgcgcgggcgatcgcgatggcccggcggatgtgccggcgctgggcggccggctcctcgtggttgtcggtgagcaggtgccgcatcgcctggtacgggtcgccgccgcgggccaccacgttgagcagcatcgcgtgcgacacctggaacgacgaggtgagcggctccggatccgcctcgaccagccggtcgaaggtgggccggccccagccgatctgaccctccggcggcttcttgcggaccaccttgcgccgcttcttcgggtcgtcaccggccttcgccagggcgcgctcgttgtcgatcacatgctccggcgcctgcacgatcaccgtgccgatggtgtcgtagccggcccgcccggcgcgcccggcgatctggtggaactcccgggccttgagcagccgggtcttcaccccgtcgtacttcgacaggccggtgaacagcacggtgcggatcggcacgttgatcccgacgccgagcgtgtccgtcccgcagatcaccttcagcagaccggcctgggccagggtctccaccagacgccggtacttcggcagcatgccggcgtggtgcacgccgatgccgtgccggatcagccgcgacagcgtacgcccgaaaccggccgcgaagcggaaattgccgatcgccttggcgatcgcgtccttctcgtcgcgggtgcacatgttgatgctcatcagcgactgcgcccgctccagcgcggccgcctgggtgaagtgcacgatgtagaccggcgcctgcttcgtggtgagcagctcctcgatcgtctcgtgcagcggggacatcgcgtactcgaagagcagcggcaccggacgctcggcgttgctgacggtcgcggtctcccgtcccgtccgacgggtcaggtcgtcgacgaaccgggtggtgtcgcccagcgtcgcggacatcagcaggaactgggcctgcggcagctcgatcagcggcacctgccacgcccagccccggtccggctcggcgtagaagtggaactcgtccatcaccacctggcccacatcggcctgggcaccctcgcgcaacgccaggttggccagcacctcggcggtgcagcagatgatcggggcgtccgcgttcacgctcgcgtcgccggtcagcatgccgacgttgtgcgcgccgaagatcgtgcacagggcgaagaacttctcgctgaccagcgccttgatcggggcggtgtagaaggtggtgcgcccgtcggccagggcggcgaagtgcgcgccggccgcgaccaggctcttacccgagccggtcggcgtgttcaggatgacgttggagccggtcgcgatctcgatcagcgcctcctcctgatgcggatacagggtgaggccctgctccgtcacccaggattgaaaggcttcgaagacggcgtcgggttcggcggtgccgggaaggcgatcggtcagcgtcatgatcctgcaattttgtcagtacgctccgaagatcgcgcgaaggggacccgccaggctgcctgcgatgctgaccacagccgcgatgaccgcgacggttgcggcgatgcgtacgcgcatgtccggatctgctcctcagattctttgatcttgtcgggtgaactgtgcccggcggcggttgcagacgtggtagccgttcggttgtagggtctgcgccgtgggacttcctgtgccggcgccgatctccgacggtgaccgtgaacgaaccgccgaactcctccagcacgcgtgcggcgacggacgcctcaccctggaggagttcagcgtccgggtcggcgcggtgtgggctgccgaaaccgacgccgagctcgcccggaccatcgacgggctgcccgcccagccggtggtcggatccgccgccaccgtcgacaaggtggtgaccatcttcagtcagacccggcggcgcggccggtggcggctgcgggaccggatcctgcgcaccaccaccctgttcggctccaccgagctcgacctgcggtccgtgctgaccggacaggacgtcatcgagatcagcggcacctgctggttcggtcagatgaccgtgatcgtgcccgagggcatggaggtcgacctgaccgggacacacgcgttcagccagcacgagctgcggctggcgccggtccggcggctccccggcacccccgaggtgcgggtcgcggtcaacgcctggttctcccaggtcaacgtggagtcccggccgcccgagctgcctactcgttgaggaggtcgcggagcaggcgctcgtcgtcggcgtccaggttgccgacgaaacggcgcagcaccgaggcgcggtccggctcgatcgccagcagccgggacatccggtcggcgaccaggccggccggaccgtgcggcgcgccgtagcggaaggcacggccgtcccgctgccggaccgcggaccccttctcgaacagccgggtcaaggtggtcacgacggtgctgtacgagacgtcgccggccggatcgagcacgtcgcggacctcgcccggggtgagcgggtgatcggcgtcggccagcaccgccatgatctcggactccaactggcccgggcgccgtctgctcacgccccgcactgtatcgaccgccgctgtgggtccacgaccgcgacccgctcggtctatcggccggcgggcaggccgggtgcggcgcggggtgcgttgatcacggacagttccagcatcggggagaggtcggcgcggcccggcccgccggcccgcacccagccgcagatgtcgtcgagcaccacgtcgtcgagcaccaggccgaaccagaccggccgggcgccgtcgcgccgcgccgccggcgtgggctgcaccaccagcacgttcgattgggcacagacatcaagacagagactgcggcgtacgcggtgagccggaccgagcgccgccgcgagccggtcgagctgggcgtcgtggtccaccgtgggatgtttgccggcgctgccacagcagcagtcccggcacaccgtgaccgtgcagccgtccatcgcgtcgtcctccatgatcgaccaccctacgggtgccgcccgcgcggtcggctgggcggtaccgccgggggaatgggagcatgcgcgggggcgcgcggaggggagccggcgatgttcgaccatttcctgtggtccgtggtggtggtgccgccgctggccgtgctggtggtgcggctgctggacgaccggatcgcgcccgcgcgggcggccgcggtgatcgcctggtcggcggtgaccgtcgcggtgaccagcatgctcaacctcctcctgctggccgcgcacgcgctcgcccaggtgccggcgatcgggcggcggttcggctggtccgccgcggtggtcgcggccgacacggccggggtcgagtgggtgccgtggctcagcgtggcactgctcgtcggcggcctgatcgcggtgatccggcgctggcggcagcagcggcgggtgctggccatggtcccggcccgcggtacgggcgacctggtgatgctgcccgacacggcgccgcgcgcgttcgccgtgcccggccaccccgggcacgtggtggtcaccaccgggatgcgcggcctgctcaccgacccgcagttcgaggccctgctcgcccacgagaacgcgcacctcgccgaacaccaccaccgcctcgcccgggtcaccgagctggccgtcgccgcccacccggccctgtggtgggtcggcggacacgtcgactacctgatcgaacgggccgccgacgaacacgccgccgcccgcctcggcaaccggcgcaccctggcgcacgcgatcggccgggccgcgctggccggcgccggcagcccgtcgcggccgcgctgcacgccgctagctagctagggtgtggttccccgccgggtggcgcacctgctccgaccgcagccggtggcagccccgcgcgccgccgtcctgctgccggtcctggtcgcgctcagctcggtgctctggaccggggaggccaccctcgacctggtcgaactcctgcacagcgcgctccgctgagccggtgcggtgatcaggtgaacagggtgcggccccagtagtcgccggcgtccggcatgccgggcgggcaggcgaacagggcgctcgaggtgtgacggatgtactcgttgagggcatcctgtttggccagctggttctggatggggacgaactgtttgcgcgggtcccgctggtaggccatgaagaacagaccggcgttcagccggcccaggccgtcggagccgtcgacgaagttgtagccgcggcgcaggatgcgggcgccggcgttctgatccgggtgggccaggcgcaggtgcgagtcgaccgggatgaccggctggccctcgccgtcctgggctttgaagtccggctcgtcgtgctcctgccggccggagagcggggcgccctcgcccttgtcccggccgatgatcgtctgctgctcggtcagcgacgagcggtcccaggtctcgaccagcatccggatcttgcgggtgaccaggtaggagccgccggtcatccagtccgggccgtcgccgggctggacccagaggtgctcgtcgagctgggccggctcctccgccttgaggttgcgggtgccgtccttgaaaccgaacaggttgcgcggggtggcctgggtggtggaggtggaggaggtgcggccgaagcccagctgggaccagcggacgctgaccttgcccatgccgatccgggccaggttgcggatcgcgtgcacggcgacctgcgggtcgtgggcgcaggcctgcacgccgatgtcgccgccggagatcgcctcctcgagcgcgtcgcgggggaatttcggcaggtcggccagggcggccgggcgtttcgcggcgatcccgaaccggtcccggccctgcgcgtcgcggaacagcgtggggccgaaaccgatggtcagggtgagaccggcggcgggcaggccgagcgcctcgccggtgtcgtccggcggggcctccagcgagccgccgaccgcgccgaacgtgccggcgtcccggccctgggtcatccgggcggccgcggccgtccagtcctgcagcatgtcgatcagggcggccttgtcgttggtgatcacgtcgaaggcgcagaagtgcagccggtcctgggccggggtgacgatcccggcctgccgtgccccgtagaacggaatcgccccggcggcgtccgccgcggagccggcgccggatgccggagtcgcggcggagtcgcggtgggtcagggccaccgcaccggctccggcgacggccactccggccgcgccggcgcctgccaacccgagcactctgcgccgttccatgccacgaacctctttccgggggatcctgcttgcggtcttgccgaggggtgttgtgggcccggacgtgcgacgacgcctcgcgtccgggccggtccgatgcggttacttcttggcgaccagcgccgccaccctgctgatcggttcggcgagggcgttgatgtcgtcgctgagttccttgaggtcggcctgggtgagctggttgtgcagcttccagccgtcgccggcgcggtgcttgtcgagcgcggcctggaccttggcgaaattgtcgtcgagggtcttgaccagggccgggtcgcggtcctgcagggccgggcggagggcctggatggcgccctgcgagccctcgatgttggcggcgaagtcccacaggtcggtgtgcgagtagcggtcctcctcgccggtgatcttgccggtggcgacctcgtcgagcaggcccttggcaccgttggcgagctccaccggagagaaggtgaccgattccgccttggtgacgatggtctggacgtccttgagcagctgatcggcgaccgggccgtccttggtgatgtccttggtcgcccagaggtccttctcgatcttgtggaagccggtccactcctggccggcctccacgtcgccgtcgcgggcgtcgatcttcgggtcgaggtcgccgaagctctcggcgaccggctcgatccgctcccagtaggtgcgggcgaccgggtacagcgccttcgccttcgccacgtcgccggccttgaccgcggcgacgaacgcggtggtctgttcgatcagggcgccggtctgcgacttgacgtagcgctggtagtcggcggtggcctgggccagcttggcgtcctcggtcagcggggcggccgaaccggacacctggaaggcgttgcggatgcccttgccgaccatgccgggcttgcaggcggtctcgtacgacccggcggggagctcgacgatcagctcgcgggacaggccgggcgcgatgttctcgatctcgcccatgatccggtcgccggccgcgtacacgtagaactcgttgatcttggagcccttgttggtgacgccgaaggtgaccgtgccggcgccggcggtgccgcggtcgaccttgcactcggtgtccgaggccgccaccgtgatcttgccggtgccggcggcgcccgaacccgctttgtcggcgcccttgtcggcgcatcccgtcaggagtagcgcggctgcggcgcctgcggtcagcagtcgtgcggtgttcatcgttctcctaggaggcggtggtggcgggggtggtgggggaggcggcggccgggcgctgggggcgcgccggccagaggaagagaatgaggaccgggatcccgtacgccagccaggcgaccgtctcgatcacggtgggcgcgggcgtaaagttgatcatgccgcggagcagctccgcgtaccacgcggtgggcgggaagctgtcggtcagatcgaacgcggtcttgtccagaccgcccaggacgttggcctcctgcaggccgtggaagccgtacttgaagatgccggcggcgaccagcaccagcagcgcgccggtccacttgaagaacgtcccgaggttgaccttgacggcgccgaagtagagcagccagccgagcacgatcgcggtgagcatgcccagcgtgatgccgatcagcggcttggcgtcggtggcgccctgcgcggccgcgtagaacaggatcgacgtctccaaaccctcccggatcaccgcgaggaacgcgacgccggccaccgcgagcgggccgacctggatcgcgccctccatccggtcgcgcaggtccgcgccgatgtggcgggccatccggcgcatccagaagatcatccaggtgacgaagagcacggcgacgaacgacgcgatcccctcgaacagctcctggttggtggagctgagctcggcgatgccgacctgcagcaggaccgcgaaaccgatggagatcaccgcggccagcgcgacgccggcccagaccgggcgcagcagcggacgccggtcgctcttgaccaggaaggccacgagaatcgagaccacgagcgtgatctccaggccctcacgcagtccgatgaggtagatggcggtcatggagctccaaaggttagccaatcctaactcggtatcgacactgtgttctacggagttgtagatgtcaaatcccgactttgtaacagtggttatataagtgctgttaggatcccggcgtggtgaacttcatcgatccgaccgaccgggcggtctggcggcccctgtgggatctgcaggcggccctggacgccgacatcgcccggctctacgccgcggccgacctcggcgggctcaagagcacctgggtgaaagagctgatcaagctgcatgccggcgggccgatgacgatcaccgagctggccgcggcggtggggcggacccactcggcgatgagccagaaggtgtccgcgatgcgcgccgccggatgggtgcggaccacggccggggctgacgggcgcaccaagaaggtggcactgaccgccaaggccgcagcggtcgccgaccggctcgccgccgaatggcgggccaccgaggaggccgtcgccgagatcgaagccgagattccgtacgggatgctccgcgtcgtgcgtgacatcgaagcggccctaagccgcaagagcttccgcgaccggatcgccgagcggctcgccggggacccggcgtggggcctcgccggggatccggcctgcggcctcgccggggatccggcgtggggctgagtgcggcgctgatcgacctccggccgctgcggagctcgccggccttccgccggttgtgggcgggcgggctgctgtccgggctgggcacgcagatgaccctggtcgccgtgatgtaccaggtgtggcggcagacccacagcacggtgtggaccggcgcggtcgcgctcgcgcaggcgctgccgatcgtggtgttcgggctgttcgccggcgcgctcgccgaccgggccgatcggcgccggctcagcctcggcaccaccgccggactcaccctgtgctccgcgctgctcaccgtgcagggcttcctcgggctgctgccggtcaccgggctgctcgccctggtcgtcgtgcaggcctgcttcgtcgcggccggcggccccgcccagcggaccttcctgccccacctgctcacggccgaggaactcccggccgggctcgccctcaagcacatctcgttccaggcggcgatgctcgccgggccggccctcggcggcctcatgctcggctggctcggtgtcggtggctgctacctggtcgacaccctgaccttcctcgccgcgctgtacggcatcgccgggctgccgtccctgcccggcggcgccgaacccggccgctccgggctccgcgccgtcggcgaaggactgcggttcatggcgcacaaccgggctgtccgcggcgccctgctcaccgacctcgcggccaccgtgctcgccatgccgatcagcctgttcccgctgatcaacgcggaacgcttcggcggcggcgaacgcaccttcggactgttcctcacctcggtcgcggtcggcggggtgatcgcgtcgctgctgtccggcacctacacccggctcggccgccccggcctgaccatgctcggcggcgccatcctgtgggggctggcgctcgcggcgttcggtctggtcaccgacccgtggctgagcctgggctgcctggccctggccgggctcgccgacaccgtctccgtcgtgtcccgggccaccgtcatccaacagcacaccccggccgcactgctcggccgggccgccgccgccgagcagatcgtcggccaggccggcccggacgtcggcaacatgcgggccggcctggtcgccggagcattctccggaccggtcgcactggtcagcggcggactgctgtgcgtcctcgcggtcggggtgatcgcccgcacctcgtcaccgcgggcgtgacttcccgaccgcggtcagcacctcggtgcgcggcttgtgacactggtcgaccgggatcgacgggtggatccaccggttctggtcgtcgagcagggcgatccacggcggcgcgatgaagatcttggtgcagaccggcgaccgggacgccgtgtcatccggcaggcgcagagccgtgaccagctccgagatgtcggtcacccgctgctccaccggcgcgctgctgccatcggcccgcggcaccggccggatctggcagaccaccgcggcgaccggcttgaacgcgtcgttgagccgggcgccggacggtgcgccggcctcatccttgcgcgcctgttcgcaggacacccacttgtcgtgcaggccggtgaccttgtcgggctgggtggcctgagccgaaccgcaaccaccggcgaccagtgccaacgcgggcagggcgaaaatccacttcctcatgggagtgagacgttagcgggccgggggcggttcccgtcaatccggcctaatcgcggggccacgcggacagccggtcacgaagatcgctgatctgggcgggatccaggccgtacagggtgaagcgggcatcatccaggcggtccaggtaacggcccgcgtcggcgatgtcctccggatccagggccggatcggcggcgtacgccaactccaggatccgatccagcggataccgttcgagcgcggccgcgacgtcgatgtagtcgcggacctcgcggcggttcaccagcgcggcgaccttggtggcgacgagatcgtccaggtgcatgaccggacccaggtccatcaccaccggggtgcggcggcggtccaggcggcacagggtcaggcgcagcgcccgatgctcgccggcgaccaggaactcctggatgtcggcgtccatgccgggaaacagttcgtcgccctcctcgcggaccacccggtagcccgccccggtcagcgccgaggtcacctcgccggccgccgcggtcaccccgcccgccgtgtcggtgaacaggtcgatgtcctcggtcggccgcgcgaccagtccgttgaccagccaggcgacgccgccgccgagaacgaacccgtgcttgtcggcgaccgccaaggcgatccgggcgacgtcacggtagaagtcgtcgacgttcatcggtgagggtccggctcgcttctggttggttcgctgtcgtccgctggtcggccgggtgcggcttcgcttgtgtcggccgggtccaggtttgcttgtgtcggccgggtccaggtttgcttgtgtcggccgggtgcggctttgcttgtgtcggccgggtccggctttgctcgtgtcggccgggtccgggttcgcttgtgtcggccgttctggcttttacgctcttcaggcggccgcgcggagccgcagcctgggatgccgggcctcccaggcggcgcggacgccgcgcggaaggttcagctcggaccagacccggaccagggtcgcgccatccagaaacgcgcgcaactcgtcgacccggatcgattcccgcagcacattttcatacatccacaagagcatcgtgcgctgcgacagatcgaacgcccgctgcggatgccaccacaggcgcaacggcaactcgacgaacccgcacgtcggcccgcgcaattccgccagggtgccggccaccaccaccggccggtgcggccgagccaggtggacaacgggtgcggcgctcgcggacatgggccaagcctaaaccggaacacctatgacaaagcaagcgcccgcattcgttcgttgcccttttctcagctttacgacctccaaaagcagccctcgattcgccaccattgattccgtcgtgtccgtgtgacgtctcccgcgatgtgggtcgcgggcgtgccgatacggtccgggctttcgccgagcgtcatccggcggcgtgggccgccgccggatgtctcgggctcctcagccgctgcggacggtcctcgcggcgtgagctgagctgtgcctgaccgacgccaactcctgttgtgtctgagcggcgctggctgccgccgtgcccgaccggcactggctgccgccgtgcccgaccgacactggctgccgccgcgtctctaccccggtgtgggctgccggtggaggccgttgtctgctcggctggcttgctgaggtggggcttggttcatggcggcgtccaagagggccagggcggtgccttgaacggtcgcggcggcctggtcacgggtctgggcggcgatgtcgatcaaccagatcagtgactcgatgccggtggcggatcggatggcgacggcgagggaccgccggtcgatggcggggtggctgtcggcaagggggcgaagtgcgtcctcgatccagccgattgccctgccgcggcggaggaggggctgctccgtgccggctgatccactgctgtcggtaccggctggtgcactgctgtccggctgcgtcgaggtggggtcgctgtccgggtgcccctgccgtgtcgcagctgggggcggtgcgtgccaaacggtgtcgtcgtggcggccggtgtgggcgcgggcagctgcgaaccggagctctggacggtcaggggtcggcacggcggtgtcccgtggagcggccagggagagccgcagggcggagcggagctggggctcccactggaggttgtaggccgtgaacgcgtccatgaacgccgtcatccgggcgcgaggctcggtcggggcggtggcatcgagcagcgtgtcgggctggatctggggctgtgccgccagcaggagcgagtgctggttggcgaagtagcggtatgccgtcgtgcgggagatgccgctgtgtgcggcggcgtcctccacccgcggcgtcagcccgtcggccagcagctcacgggtggcctcgaccagcgcctgccgggtgcgggacttctgccgggtgcgcccggtcgactcatatggcatccgcatgcccatcatggtaccgtcgtcccacgaggcacggcaaccggaggtggcaagtccgatgagcagtcacgatccgatccagaccgatcccgacctctacaaggtggtcttcgagaacgagcgcgtgcgcgtcctggaatatcgggatgcaccaggagacaagacccatactcatcggcatccggacagcgtgatggtgaccctcagcagcttccggcgccgggtcagttccggcgatcaggctgtcgatgtggagctgcccgcgggcgccgtccgctgggtcggggcgcaggagcatcaaggccacaacgtcggggacaccccgacgcacggcatcttcatcgagctcaaggagaagcccgcggttcaggttcccgggctgctcggcccacagacctgatcattcgccgagcgccgggtcaggttcaggcgaatctttccgttgtcagcgggacaagtccctgacggcgtacgtcggcggtcaacttccgcaggacggtgccggtgatgtcggcggtttcggcgcccagcagcacggtcacgtcgagcccccaggctatgccctggccgacccggcgcagattccaggtgaacaggtggtcaccggcccgcccgttgccggagggcatgcccccgccggtggtgccgcgccaggcggcggacagttcggccagttgtgcggctcgcggttctttggcgaacagcactcgatagatccgcttctcctgaaagccgtcgggggtgtcgtccatgctcaagcgcaacggcgcggcgttcgcgaagcgtacgacttctccgaacactccgcgcagagccgcctcggtcggcagggccccaccactgagttcgagatgaatccgctccgcccgatcgcgggtgatcggcgtggccgtggcgagcaactgctcattggtgcgcagcaggcggccgaagctgcccgcgtcagaccagccgtcgctacccgccgaccacatcgcgccgctcagggcaacggtgacgtggtccggtccgtaggtgaactcctcgaccagcagaacgtccccggccaacaggtagtaatccatcgacatcccccatgacaacacccgtctatggaaaccggtgccggtcgatgtcgcgggaaacgacgcgccccttgcactgtccagtagccgacccgcccaggctggtgggcaggtcccgcggaggacggtcagaccgaggaatcagcgagaacgcacctgaggaggcacgaagtcacggagccggaacgatgaggccgcgtatccgtgtcacggggtcggactgacgcggtcggactggcggggtcccggttacggagtcaggtggccggggggttacggagtcacggggccggggagtgccttgcgggcggcttcgtggtcgccggtgaggctggaccaagggagccggttccacagcgcgagcaggatgtccgcggccggaccggagagggtggtgatcgggtcgccctcgcccagggtccatgactcggcgagatcggtggcggcgaaacagacggccgcggtgggagcgggaatgcgaccgagtgcgatctgccgcgggaggaaggtgtcgccgacttcggcaatgccgtcggcgcaccatgcggggtcgagttcgctggggaggtggagggcgttttcggcgtcccagcggtggatcagggtttccagccagcggcggcggcgccagaaggcgacggttcgcggtggccagaatgtcgaggcttcggtgtccgggtcggcggacagagtggcgaggaggatgcggctggattcctcgacccacggggcgatgtcgtccggggcgggcgggccttggaaacggccgtgccgttcggtgaccgcggtggctgcccagaggttgccctgagccaggtggccggccaggtcacggagggtccagtcgccgcagtgctcgaccggggcgtccaggtcaccggtcaggcgcgactggaaggtggtcagttcgttacgcaggagtgccaggtagtcgggtcccatgggcgggaccctaccgaggactgacactgggagggtgccccttggacgcttgcaccatgtgattgtggactgtcccgagccgcgggagcttgccgagttctggagcgcggtgctgggggaaccggtcacctacgacgacggtgacttcgtggtggtgtcggctgatacgaccacgtccgggttggcctttcagcgggcgccggaccatcgggcgccgacctggccggatgcggcggtgccgcagcaacttcacctggacgtcatggtggaggacgtggcgctggcaggcgcggcggtggtcgcgctcggcgccgtggcgttgcctggtgatcacgtgttcgctgacccggcggggcatccgttctgcctcatcccgcggcccggctgggcgccgccaatgcaatagtccgcgcccgcttgcctgcccgcgcccgcccgcttgcctgcccgctagctagctaggctcggtcgctcgcatgccggcccgatccgctttgagcctgcgtgtggcctgatgccggcctgcgtctgtgcctcgtcggcggtggcgcggcgtgggctgggtcaggagtggggatggtgagggcggaggtgggagcgttcgccctcctggtcgaggatgcagaggacttcggcggggccgccggcggagccgaaggcgtgcgggaccatggtggagaactcggcggcttcgccggctcggacggtgatcgtgcggtcggccaggcggagcgtgatggtgccggcgaggacgacgaaccagtcgcggccggggtggactctcaagtcctgggggacggggcggtcgatccggagtttggcgacggtcatgccggtgggggcgccttcgcggttcagcagccaggtggtcatgccgcgggagtcgtcgtggtgggggcggatcaccacgtcctcgtcgcggcctgactcgaccagctggtcgagggtggtgccgagggcccgggcgatgggggccagctggtcgagggcgatgcggcggtggccggtttcgatgcggctcaaggttgacggagtgaggtaggcgcgggaggccagctcgtcgagggtccagccgcgggcgatccggaggcctcggatccgctgccggaccagaacatccaactctccgtcttgcgtcatgcgcaagatgatatgcccataacgcaaggtgggggtagcgtcgaggcatggcgaacgaacacggtcacggcgggcagcacggtaacggtgagctcaggggtgacgcgcagctccggcatggcgggcatgggcatggcggcgacggatccggcgggcatgggcatggcgggcatgggcatggcggccatgcggacggcggtgacgggtccgggcttgctcagatgcttgatcttgatgcggaggtgttgggggactactaccgggagctgatggactgggctgcttcgctggtgccgggggagccggcaatcgtcgacctcggggcggggaccgggacgggaaccattgcgctggctcggcatctggtgggggctcgggtgaccgcggtggatgtcgatgaggagatgcttgccctgctgcggcagcgggtggatgcggcggggctccgggacagggttcggacggttcgggcggatctggacggcgactggccggcgctcggggcggcggatctggtgtgggcttccgcgtcgatgcatcatctggctgatccgcagcggaccttggagcaggtcaaggatgtgctgcggccgggcggcgtattcatgatcacggagctggacgggttcccgcggtttctgagcgatccggcgggtgtggcactggaggaacggtgccatgccgagctggcgcggatgcggttggagggcggcctgcacatgggtgaggactggggtgcccggcttacggcggcggggttcgcggtcgaggcggaacgccgcttcgacatcgacctgacaccgccgttgccgccgcaggccgggcgctacgcgcaggtgacgctggagcgcacggcgagccggcttgctgatcggctcagcggcgacgacctcgcggcgctgcgcgactacgccgcgagcgcgccggcccggtccgacctgaccgtccgcgccacccgcgacgtctggatcggccgccgcccctgacggtccggccgaaaccgcccaccggcgatgcgctccgggagcgtgcgtaccggcggcgcgtccgaacagccgcgcgtgcggcggcgcgccgcgaaaaggccggccggtggtgtgcgggggagagcgggtggtcctcccgaggccggtccgggaggggcggtgtcagctcaggcgggtcgtcacgatcaggttgtggagggcggtgacggtggcttcggcggggcggtccgggagcgccgaggcgtccttcgccgcttccaggtcggcgcgcaggcgggggatgtcggcggccaggcgggtggccactccgggcgggaacgggccgtgttcggcctcgcgcttggcggcgatcaggtccgggacgtaggcgatctcggcccccagcacgcccagatccgtctccaggcgcccggtcctcatcagatggatgccggtcagcagcacccgtagggtgtacagcgccggtttcagttcgccggttttcgcgtacagcttctcctggctgtgtgagaagcccaggtagtggtagctgtgatgccgggtgatcaggccgggtgccagcgcggtcagcgcctcgtgcagcgggctggtgaccacgaccagcggggacagcagctgctccagcacgtaaccgttgcggctgttcagcagcttggcgaacttcagcaggtcgtgggagaccacgtcgagttcgacgccgtcgcggacgccgccgcgctgcagggtttccgggccgtggtgcaggccgacgacctcggcggcgggcagcacgtgggcggcgcgcaggtcgaggtccgagtcgacggaggcgaaaccgtacaggtgggccccgctgaccgtgcagaagaccaggggatacgggagttcccgggcggccgaggcggcccaggacggcacgtcgatcgtcatgacaacctccgttggcggattccggtcaacaggtgctcgacccggtcgcggtccgggtcggacggcagccgggtctcggaccgggcgcggtccaggtcggccagcaggtcggcggcccagccggtgaccgcctcccaggacagctcgccgtgcctgacggcgagcagccggtcccgcagcgggcgcacgtcgaccagcacctcgccggtgcgcagcacatgcgcgccggcgatcagcagccggatcatgtgcatcgcctgcttgtggttggtctccccggtccgggcccgacgggcggcgacccggtccagctgatcgcgggcatagttgccgtaggtgtcggcgacgcggcgggagaggaacgccgtacgcgcggcaagaagctcttcgccgtccgcggtgaccgtttcgaccagcggcgaccagaggacctccagcacggtggggttggcctgcagggcgagcgtgcagaaccgctcgacctcccaggagaactgctcctcgaccggcccgtcgagatgggtgggcggtttgtcgaggcgccagaagtcccgggtgggcgccgcgtagacgccccggcggtcgtggtcgctgcccggcccgtccagcccgtaggcgcgggacccgaccacgaccccgaggatcgtgtgcttctcgacaaggtccgtcatgatccggaaccgtagtcaatcagtcccgggccggcgacgggtttacaggtcgaggacggtggcgtcgatctcgcccagctcggcctcggagagcaccgggttggtcagcgcggcgatgttgtcctccagctgccgcacgctggacgcgccgatgatcaggctggtcatccgcgggtcgcgcagcgcccaggccagggccagctgggcgagcgactggccgcgccgctgggcgatgtcgtcgagcgcgtgcagccggccgagagtcttggcgtccagggcgtcctcgtcgaggaacacgctggtgcggatccgggagtcgtccgggatgccgttgaggtaccggtcggtgagcaggccctgctgcagcgggctgaacgcgatgcagccggcgcccacctcctcgagggtgtcgagcaggttgtcgtgttcgatccagcggttcaggatcgagtacgacggctggtggatcagcaggggcgtgccgagatcgcgcaggatcgccgcggcccgggcggtctgctcggccttgtagttgctgagaccgacgtacaacgccttgccggatctgacgatccggtccagcgcggacatggtctcctccagcggcgtctccgggtcgggccggtggtggtagaagacgtcgacgtagtcgacgccgagccgccgcaacgactggtcgagcgagctgatcaggtacttgcgcgagccgaagtcaccgtacgggccgtcccacatggcgtagccggccttcgacgagatgatcatctcgtcgcggtggtggcggaagtcggcggccaggatgcggccgaagttggtctccgcgctgcccggcggcggaccgtagttgttggccaggtcgaagtgggtgaccccgaggtcgaaggcacggcggacgatgtcgcgctggcggtcggcggggcggccgtcaccgaagttgtgccacaggcccagcgagatggcggggagtctgaggccgctgcggccggcgcggcggtacgtcatggacgcgtagcggttctcggcaggggagtaggtcacacgtacagcctaggcattccgatcttgatcgtgtgcgctggtaggttggtggggacccgcgtgggagagaccgatcatcggcgccgaagaggcaaatcctccccggaaactttcaggcaaacggaccgcgcgggccagcgactctgaagtgcccgaaacggggtatgacagagggggaggttgttcctcgaccttctcaccgcgctggagtcgcccatgacctcgtcattcacgcaccgccacatcggcccgcaggccgacgagcaggcggcgatgctcaaagccgtcgggtacgcgtcgctcgacgagctgatggatgccgcgatccccgagtcgatccggttccgtggcgacctggacctgccctccggtgcctccgaggaggagacgatcgccgagctgcggtcgatcgcggcccgcaacaccgtggccaccccgatgatcggcctcggctactacggcacccacacgcccgcggtgatcaagcggaacgtcctggagaacccggcgtggtacaccgcgtacaccccgtatcagccggagatcagccagggccgcctcgaggcgctgctcaacttccagaccatggtcaccgacctgaccgggctgaccaccgcgaacgcctcgatgctcgacgaggccacggcggtcgcggaggcgatgacgctcgcgcgccgctcctgccgcagcaagagcccggtgtacgtcgtggacgccgacaccctcccgcagacgctcgccgtgctgcgcacccgggccgaaccgctcgggatcgaggtgcggctcatcgacctggacgccggcgccgacctgcccgacgagttcttcggcctgcacctgcagtacccgggtgcgtccggcgcggtccgtgaccacgccgccctggtcgaggcggcgcacgccaagggcgccctggtcaccgtcgccgccgacctgctcgcgctgaccctgctgcgtgcccccggtgagatcggggcggacatcgcggccggcaccacgcagcgtttcggggtgccgctgggcttcggcggcccgcacgccggctatctggcggtgcgcgccggcctggagcgcagcctgcccggccgcctggtcggggtgtccaaggacgccgacggggcgccggcgtaccggctcgcgctgcagacccgggagcagcacatccgccgggagaaggcgaccagcaacatctgcaccgcgcaggtgctgctcgcggtgatggccagcatgtacgcggtgtaccacggcccggccgggctgcgcgcgatcgcccagcggacgcacgggcacgcgctgaccctggccggcagcctgagcgcggccggcgtcgaggtcgcccaccgggcgttcttcgacacggtcaccgcggtggtgccgggccgggccgcggcgatcgtcgcggccgccgccgagcagggcgtggacctgcgcctggtggacgccgaccgggtgtcggtcgcgaccgacgagacgaccacggcggcgcacgtcgccaccgtgctggccgcgttcggagtgccggtggccgaggccgccgagtgcggtgcgaaggccctggcccgcaccggcgactacctgcaccacccggtgttcaacacccaccactcggagaccggcatgctgcgctacctgcgcaagctgtccgaccgggactacgcgctggaccgcggcatgatcccgctgggctcctgcacgatgaagctgaacgccaccaccgagatggaggcggtcacctggccggagttcgccaacatccacccgttcgcgccggcgtcgcagaccgagggctacgaggacctcgtcgcccagctggaacgctggctcgccgagatcaccgggtacgacgcggtcagcgtccagccgaacgccggctcgcagggtgagctggccggtctgctggcgatccgcggctaccaccgctcgcgcggctcgctggggcgcgacgtctgcctgatcccgtcgtcggcgcacggcaccaacgcggccagcgccgtgatggccggcatgcgggtggtcgtggtggcctgcgacgagaacggcaacgtcgacctgaccgacctggccgccaagatcgagaagcaccgggacgcgctggccgcgatcatggtgacctacccgtcgacccacggcgtctacgagaccggcatcgccgagctctgcgagcgggtgcacgaggccggcggccaggtgtacgtcgacggtgccaacctgaacgcgctggtcggcttcgccaagccgggcaggttcggcgccgacgtgtcgcacctgaacctgcacaagacgttctgcatcccgcacggcggtggtggccccggcgtcggcccggtcgcggtccgcgcgcatctggccgagttcctgcccgggaaccccctggagcagggcgaccaccacgcggtctcggccgccgcgcacggctcggccggcatcctgccgatctcctgggcgtacgtgcggatgatgggcccggacggcctggcccaggccaccgccaccgcggtcctggcggccaactacgtggcgagccggctgcgcgagcacttcccggtgctgtacgccggggagaacggtctggtcgcccacgagtgcatcctcgacctgcggccgatcaccaaggccaccggggtcagcgtcgacgacgtggcgaagcggctgatcgactacggcttccacgcgccgaccatgtcgttcccggttgccggcaccctgatggtggagccgaccgagagcgaggacctggccgaactggaccggttctgcgccgcgctgatcgcgatcaaggcggagatcgaccaggtggccgcggggacctggccgcgggacgacaatccgctggcgaacgcgccgcacaccgcctccgcggtgaccgcggacgagtggtcgcacccgtacccgcgttcggtggccggtttcccggagggcgtcgaccggacggcgaaatactggccgccggtacgccgcatcgacggggcgtacggggaccggaacctggtctgctcatgcccctcgccggaggcgttcgagagctgatcccgggtctctagcgcaggtcgcggtcgtcatgatcgcggcctgcgccgtcttcggggagggccggaacttccgccaaaccgggcggccgtattgttaccctcagtgatttacgccgcgagggcgtggcgggccggaccgcggtgcggctcgatcgtcgtgccgtccggcagcagctcgccggtgtcctcgaagacgatgacgccgttgcagagcaggctccagccctgttcgcagaaggtcgccacggtacgggccgcctcccggtcgatagcgtcggcgggcggacattgattcaggtgctggcacatcgggtttactccggtagggggctgtgtgaaggttcacaaagtcgggctcgaacgttacctcagatcgaacgatgacggtgcactgcggtgacggtgccgagccacggtttcgcggtttcgatggtccacgctgagacccctcgcgaccactcttcgccacctcctcccggtgctccgccggcggcgccgaccacctgcaccgcccgtcaccatgcgttacgttccttttcgtggcaccggggtgattccggtgaccctgccgagcttgtgaccgggttcctggccgacaacggactgccggtgcgaaacctcggccgaacggatgacaaagacaggactatcggccatggcgctatctgcggagcgtcgctctacgtgtcggctgatgccggatccgtaatgatcaacgccactcccggcggccccagtccgatccccgtggtaccggacgtgtacgccgtcgtctgggtacacgccagcgtggccccgcccggttcaaccggagactgggaactcggttcctggcacgaaagctggaccaccgacgagcacgcccgggccgtccaggacgtgcgtgacgcgatcggccgcggtgacgtctaccaggtcaacgtggtggggcacgcggccgcggcgtacaccggaaatccgcaggcggccctgcgccgcgtcgccgccctgcccggcgcccgctacggcgggatcctcgccgacgaccgggccggctgggcgatcgccaccgcctccccggagaccctggtcgaggtgcgcgacgggcgcgtcgtcacccggccgatcaagggcacccggccggccaccgcggccggccgccgggaactgctcgcctcggccaaggagcgcgccgagcacatcatgatcgtcgacctggaacgcaacgacctcgcccggctccccggcaccggtccggtccgcgtcgacgaactgttcgcggtccgccgatggtgcggactctggcaggccgaatcggtcgtctccgcgcccctgacgggtgacgtcggactcgccgacctgctccgcgcggtctgccccggcggcagtgtcaccggcgcccccaagatcgccgcgttggcccggatcgccgccctggagccggtcggccgcggggtcagcatgggcgccctcggctggatcgggcacgaccacctcgacctggggctgagcatccgcaccgtggcggtcgacggccggcgggtgcacgcctgggccggtggcgggatcaccgcggacagcgatccggaagccgaggtcgccgaggccgccgcgaaagccgcaccgctgcgtgccgccctcgccgggacggtcaccgccaccgcatagcggtgcggagcgtcttctacctattgcgtgccactctccctgtccgcccgcacgatcggggccggagcgcgtacgttgacgcacgcgtttccccggacacggtccacagtgactgcagagaaggcaacacccatgctcgatgccctcgacccgcccgccgcggtggagttcacccgtttcgcgcgggacacccggcagcgcctgcacggcagcgccttccagctctgccgcgactggcacctggcgcaggacctgacccaggccacgctgaccaagctgtttctgagctgggagcgggccgcggacagcgacaacctttcggcgtacgcgcagaagatcctctttcgcacgtacgtcgatcatcgccggcgccgcgcctcgaccgaggcggccatcggcgagctgagtgagccggcctactcgatcgacccggacctgcggatcaccgtgctcgccgcgctcggccggctgcccgcccgggaccgcgccatcgtgctgctgcgctacttcgccgaccacagtgtcgagcaggtggccgccgagctggacgtgccgatcaccgtcgtgaagagccagacccggcgctcgctgatcaagctcaagcacatgctcgtcggtgaccgtcaggctctgcttgccgcgtgagggtagacttcgctgcgaaggggagtagtccttcgccggtcgttcgacatcctggagcccgcccgggctcccggcgcccgggccccgctggggtggaccagaccttcggccctgcagtgacgtgagtcgccgcggacaggggccggggtctcggcgtgcctggggtttcggtctcctgccacggcaggagaggaccggccatggcagccgtcggacacgacctgcgcggacgtctgatgcccgcgctcaactatccggccggggcgctgctgatcgtcgccggagtgcccggggccggcaaaaccaccctgctccagcggctcctcccgcacccgggtgtccggctgctcgactccggccaggcccgcgaggagttgcggccctacctcggcgcggtgccgtaccggtactggcgacccgtcgtgcacgcggcccactacgtgcggctgtaccgggcgctgcgacagcccggggccatcgtggtgcacgaatccggcacccgccgctgggctaccaggctgatcaccgccgcggcccgccgggccggccggcgcacccacctgctgttgctcgacgtcgacccggcgcaggcgcgggccgggcaggtggcccgcaaccggaaggtgcggcggtcgtcgttcgccgggcactgccggaactggcagcggctgctgcgatcggtggccgacccggccgatcggatccaccgggacaccgccaccatcaccatcatcgaccggccgctggcggccgggctgaccgcgatccggttcgacgggctgcacatcgttcccgcggcgcgggctctgcgtcgcgcggcctagccaggcgggccgtggcccggctttgtccgtggcccggctttgtccgcggcccggccggcggcgacgcgccgatggtagccggtgaccgcgagcagcaggccggcccggagcagcacctcgaccagcgtgccggtgtcgtgcgggcctgtcggggcggtggtgtaaccggcgtacgcccggaagttgcgccgctgctgcggcggcaggacgaggtgcggcacccgggcagggtgcaacggtcccgcacgccggcgggtaacgagcggataggctctcgggcatgacgatccggccgattcggctctatggtgacccggtcctgcgcacccctgccgacccggtcaccgacttcgacgccagcctgcgcgagatcgtgcgggacctcgaggacaccgtccgggaaccgggacgggccggggtcgccgggccgcagatcggggtcgggctgcgggtgttctcctacaacgtcgccgggcaggtcggacacctgatcaacccggtgctcagcgacttcgacggggagcaggaggacgacgaggcgtgcctgtcgctgcccggcctcggatactccacgaaacgggccatgtcggtcaccgcacgcggcttcgaccagcacggggagccgctggtgatccacgggaccgggttcctcgcgcgggcactgcagcacgagaccgatcacctcgacggccgcctctacatcgacacgctgaccggcgacacccgccgccaggcgctgcgcgagctgcgccgggtcgtcccgcggtgaccgttcctgatccgaccgacacgcggcggtacgcggcgcagtcgctcgccgcgggcgatgcgacgggctggttcgagcggctctaccgcgacgcccgtgccggccgggcggtcgtgccctgggacgtcgcggcggcgagcgtgagcctgcgcgagttcccgctgccacccggtgacggccgagccgccctggtggtcggctgcggtccggggcgcgacgcggaacacctggccgcgctcggctacgcggtgaccgctttcgacatctcggcgacggcgatcgacctggcccggcagcggcatccggggtcgtcggtcgactaccgggtggccgacctgctcgacccgccggcctcctggcggcgggctttcgcgctggtgctggagagcaacaacgtgcaggcactgcccgcgcagatccgggcgcgggcgatcggtgcggtgggcgggttcgtggccgacggcgggacgctgctggtcctggccgcggcggccaccgacgacccggccgcggggccgccctggccgctgagccgggcggagatcggcgccttcgctgcgccgggcctgcgcgaggtctcggtcgaggagctggccacgccggggtcgcggttgccggcccgctggcgggccgtcttcacgcggtgagggaccttgtccgcgtgacccgctgacgtccgcaccggccgggccgttgacgcggggagcagcggggtggcgcgccggggcgtgccgtccgcggcgggcttcgcgggctcggcgggtggtgcgggcccggcgggcggttcgggtttcgggggctcggcgggcggtccgggtatcgcgggtctcggcgggtgagctgatcccgggtttcgggggctcggcgggtgggctcacggcgtacgcgccaatcgaaacgatcgggaggtcggcgaaggctggacgtgtccgcctaccctgtcgccgtgatcttgcgagggcgatggtcggtggccggcgcggcggtcgtggtcgtcatggccggtgtcgtggtctacgaagtccggaagccccggggggacgacctgccggacacggtgcgcgacggcctcgcggtggcggcccgggacgcgatcgagggcgccgccaccggtgaccggctggcctgcgcggtccgggtcatcggcgcggatccgccgacggcgacggccgcggcgcaggtgcgtacggcgtacgtgtggtcgttgtgcgagacggtcggcgcccgggtccagtccggatcgtcgatgccggccgcggtgcatctgaccgttccgccgacggtggagacgcccggtgacggtgtcgcctacggcccggacctcgagcggatcttccccgcccggctccgcgatgcggtcctcgacgtcgacggcgccgccctggagccccaggttcggcagcggatccgcgagcgctcctgagcccgcacccggtgagtggctgtctcgcgacctgtttccgcagctagcgtgactattgcaccgctgagctcagtctctgccgttcggatcggcgtaccggtgacgccgatgcgaacgcgtgaagctctcgatcagccggcggtaagatcgcggcgagttcggactggtcagcgagcgggagcgtcagcatgggtacctgggacgtcgggccattcgacaatgacaccgccgcggattggtgcggtgatctggacgaggccgccccggggcagcgagaagcgctgatccgcgatgcgttgaatagggtcgccgagcacggcgacgagtatctcgacagcgacgaggcagtggaggcgatcgccgccgcggccatcgtcgcatctcaactgccgggcgggacggcgattacgaccccctacgcacccgacttcctgctggagggcggccggatcgaggtacccgacgatatccccgccatcgcagtacgagctttggatcggatcgtcggggacgactcggagtggcgtgagctgtgggcggaggctgaggagtcgtatccgcaggcgctcgcctcggtgcaagccatccgcgacactctcgaacgggcgattcgccgctgagctgagcgcctgttcgccgacgcacgagtcgggacaacgtccgcttcgaccatgatctgcgcctctggcgagcctgctgatctggccgcaatgggctgaggtagcgcaggccgccggccatccgcgcgcgtgatccgacgggtcatgagggcgatgtctgcccgagtgcaagagatggaggcgccggtgcccggatctgccgaattgagtgcgtctgaccaccgagtgggccactacctgttcgtgttggccgcattaagagaaccttgacccacccgcggccaggtgggctcaaatggcagacgtggcggggtgaggacacggataacgaagcggttgtgcaccaggaaaacctgctcagggatgccacgagcaagcgtgttgcgacgcggcttgccgtggcggaggatcggaagacgccacccgggatcatcgctcgtctggccgtcgacccgtcgacgagagttcgccgggccgttgccgttcgctcggatctgacacgaacggtgctcaacacgctcgcatcggacgacgacaggaacgtgcgggaagcggtggcagccaacccggcaacatcccaagaagacctgatccggctcgtcggcgatccgcacccgcacgtccgctgggaggtggcagacaatcccgggtgcgacgaacacgtgcagcgcgcgatctgtgcgtcacccgacgaggatcttcgcttcaagctcgtctaccgcaaagacctcgcgcccgacgtagtagcggcgctcgttgccgacagctccgtcaatgtccgcagtgaacttgccttcgaaacggctgattcggtcgccttggccgccttgggcgccgactccgtcgccaaagtccgagccggcgcggcaatgaacacccgcacgacggccgagcaacgccgcgtcctcgccagggatcgctcagcgctggtccggtccgcactcgttcgcgccgtcaccctggaggagaaagacctccagcggctcgcccgagatcgatcggtagaggtccgctggcggatggccgccgcgctcattaccccacgacacatccgcgacatcctcagacaggaccctgacgcctcagtccgctcgcaggcggaggatccttcgtactaaatcgcctcgccggcgcatccgcagacggcgccaccctgttccctgcccacggtgcctatcctcggcactttcaactgccgacgagagtgcgttcaagcccatgatttgaacgccaaataagccagcgatgaagcggctcctgccatttgaaggcctggactatatccgcggatgaccctagggtgcgacgaacctcgtcgctcgcgatcttggtgaatgatttgtccggaccgtcaagcgctatacatccgacaaccttccggatagccgacgagtcgtcaaaaacaggagtagccagcgcaacgtgatgccgttcgatcgtactgtgaaactccgagtggctcatgcccatccggtcggcagtgggtaatgcgttccactgatcctccgtaaggcctttatgcgccttccaatgcttttgaggtcaatccactggtcttgacccgtttcgacgcataggccgatgatgcctttgcctggccgccacacgacagccgtcgtggcgcggcgtcgtcgggatcgatcgcggaacacccgcactagccgcgtttggcgggtcagtcttcggttgacccaagttggccaccgttctttacgtaccgcatacagggcgattcccaaatcgcctggaggaattcctgtcagtcgtgatatctcgtacattgccgtccgcagtgtatcgccgatcttttgaatatcctccaagcgtcgactcttgcgacgctcggcgaaggcaccagaaatttgcgttagtagagtaattatgccggaagcgatagccagatacgcacgagtcagatctgaagcattccagacgcgagtctggatcaaggccagtgcgatcacgagcgccgctgcaattgcggcaaggactatcttgcgatagagggacgaacgccctgatttcacatcatcctccccgaaagcctatgtagcacaatagggggcattggtgttgctgtcttggattcgcgatccttgggctggcttatctgccgaccggacggcgggaacggggaaaccaccaatcggtttgtctggcggaatgcaaaaatcgctcggttcgtgcaacaacaggcgttccggagcgcctgagggcgtgggtcgaaccggtggaagtgcgaggcgactcacggcggtcatgcgcgtgatgcacgaacggcggcctggataggcgctacggacctgggttgagctgcgcggccgtactcaaggctgctggctggcattcctcgccacatcggacatgtcttcgtcaacaccggcaatcgcgactgactccgcaccagcaatgtccattgcgcaagcgatctctgtatctggagcttcgcttccactgatgtccaacttcagcacaagccggcagaaggcttacgcgttgcgcgacgaagttcatagggacaccccaccgacaccagctgatggttgcgcccttgtgccaggatggcgggccggaacggcgcaggcgctaccggaggacagccatggtgaccagcaaaatcggcaggatcgccataggcatggtcagcaccccgctgctgctgttcgtggcgattccgctcgtgttggccctgctggatgcggtgaccagcgcgggcaatcagacaggtgaaatggatcgcacgatccagtggatgttcgtgatcgaggtggcgcccttcctgaccgaaccgattcgcgagttcatcgacgcacgcgccgcggagctttcagtcagcgctgacgtactgtggtcagcctggcagttcaccgcgctggcgatcctggtagccggctttaccggggtgctctgggcccggattgcccggctgggattgtgtctgagcatcggtgggatgctctgggtgaccaccacaggcctgcaccggcaggcgacgctgagcttcacactggcgtggctgatgctcgaggtagtgctgagcatccggccggtcgaacgccttcgccggtcgcgcgcgatcgaactccttcgccggttctggcggaatctgacgcgtccgcagctggcgtcgtacgaacagcagcatctcgaaatcgaggtgctgccggaacattccctggatgctcgttcaggcacccccaacggccagcctcagcggtgatttcgacaccatcatccaactctccttgcgcctggggccgagcaggccactccggggtgatgagaatcgatagcggtcgtcccggcgggctttggtctgggtcaactctcatgccgccgagaaggctagtgatgtcgtcgggcggaccctgggggatgtcgaacgtcctccagccagccttcgtgcgaagaccgcttccgggatagggaggtcggcaggcgatgggtacctggggcgctggaccgttcgacaacgacgacgccgcggacctcgctggcgaccttgacgacgcgccggcgcatgtccgggtcgagatgatcggtgccgtcctcgcacgcgttgccgacccagccgacgacgactcccagctctcggacgctccacgcgtcgtcgccgcagctgccttgattgcagcccagtgcccaggtggtgctcccgtcgtctccaactatggcccgggcacgcccatgccgcagttccctatgtacctgcgaggcctcgccatcaacgcgttggactgtttgatcgcgaaaccgacatggctagcagatgcttggagggagagcccgaacggccccgaatggcgccggaccgtttcagatctccgcgccgttctggacccgcctcagcaggaagcactcttcgcactttgagagacgcgccgcactcatctgccgcagtccgcgcacaggacgcgcggagcacgtcacgcaccgtgtgcggcactctcgctcccggccggccgctcagtcatagccgtagtcgctctccggccgcagcgcttggaggaagctgacgaaatccggcgccagtacggtgatccggtagtcaacctcctgatccacgtggacaacgcgcggttcgccccgggggccgcagtcccggtagtcgaacgcgatcatgtcgtggccggccgaaggacggtcagcgaagtacacgccgatctctggatagccccactcctggatgaggaaccggctgcccgagcgcccagccagggaacagtccttctcccgtccgatccccatgatcgcggtgagggcgacgtggtcttcggcccagctcgttccgctcggagccggacactgccgggatccgcgcgccagctgacgccagactgctcggatagagctcgactccgcgacaatgcgtagtcggcggcggtcggtcgggggactgtgccgatcgcggtacggaccctcggtcggacgccgcgcaaccagttggtcggctattgctggacaacttgacagatcagattccacagaaggcggggcagcaccttgaagccgacccggttcggcggcctattcacgaccttgaaggtgaggttgaggtcgttgcgggcccggtcggccagacctgtgtaggcgttgtcggcccacatcagggtcacctccgggttgttcttgcgcagcttaggaagcatctcgcgggcggcatcgcggtcggtgacgtctgccggtgtcacctgcaccgtcatcaacagacccttcgtgtccacgattgagactggggtggaagatggtctggcgccgacgatccgtcgggtggctggatattccgatgctcgccgaaccggcatttccaggccggtgtggaggcttccggcattacgcagaccctgaagggatcggcttgcgacacctacacttaggaggtttgagctcctcgttgtcggtctggtcgcggagatctgtgatgcgttggcgagcagctgcagcgtggatgatggcgattattgtgtgcgtggcatcggcgggttgttcacaccgctccgggccgccgcagatgagctcggcggctcgtgcctacttggcgcgggcccttgatctgctccagcgcaattcgattgacgccggcgcggtcgactggccggtgcttcgggctaaggcctacgaggtggctgccacggcacagacgagcaccgacacctacgaggcgatccaccgggcggtctacctgctgcacgacgcgcacacccgtttcttcacccggaccgaggccaaccttgcgttcgaccaggccactatgtcggacggcccacccaccggacggattctgcccggcggctatgccctgttgacggttcccgcgatgagcggcaacgaccaagccgtggccgcctacatgaagggcggcgttcaagccgtccatgagctggatcaggaccacccctgcggctgggtcgtcgacctgcgcggaaacgggggcgggaacatgtggccgatgctcaccgcgctggcgccgctactcatcgggcccactctcggctacttcgtcgacgcatcaggtaagcgcagttcgtggatcctgcgggacggccaactgttcgtcgacggcagcccacagctaccgcaacccgacaactattcgttggcccgaccgcagccaccggtggcgatcctcaccgacccactcaccgccagcgctgcagaggccacactcatcgccttccgcggacaggcgaacagccgaacgttcggccaaccgaccgccggatttccctcagccaacgaggccttcgcactaagcgacggcgccgttcttctgatcacggttgccaacgacgccgaccgaactggccacgtctatcccaacctcgtcgcgatcccaccagatcaacccgtgtcgcattcaaagccgggccccagcaccccgcgcggagctgatccggtcatcgacgccgcgacccaatggcttgccggcacaccggcctgccggtaaccgatccacgtccctcctttcgcatttctcacacccacctcggcacacggacatacatgcccgggcacggcgtcacgagatcgcacgcctcccgctcgccccggccggacacgagaccgacgaccaggcccagcaacgcgggcagacatccggtcgtctcgagtaccgcacatgcgtaggtggcgagcgcactacattcggcagatccggatgttgccgaccgccccaccgtcacgccgcgtagctgacgaaattcaggcgcgggtccatccgtcccatctgccgaacgccctcgtcctgaggaccacccagacggactacaacggctgccccagcaccgcgcttcgcaccgctcatcccacgagcgtaaaaccgaccctgaagcgatcttgaagtagcgagccaggcagtgagcgggaatgccgcgaccgggaacgacgatcccatggggaatgacatgccgcggtcccgagccgggattccgcggtcgggaaccgaaaggccgtcgcgagctggcggtcaggaaccggccgggtccaggtgggcgcgcagcgtcagcgccagctcgtcgcgctccgcctcggtgaggccctgggtcggagccttggcaagataccggaagacggcggggccgcggcggtcgtccgggaggtccggcatccggggcacgatggggaagtggacgtggccgaagccgtcctgctccgcgaactgcaccacgtaggtcttcgcgcagcgggtcgcggcgtgcagggcgcgggacacccggacctgccacgtgccgagagccgccgcctcgtcgtcggtcaggtcggcgatcgcggtgacgtggcggcgggggatcagcaccagccagccgggcagcgtgctggtgaaggcgtggaccacccgccagtgcgggtcggccgcgatccgctcgcggggcggcgggtcgtcgaaccgggcgtcggtcgcgcaggcgaggcaatccacgcctggacgatagcggccggcctcaagtcaccaggtgtcaccggccatgttgtaggggcgggcctcgccggggctcggctcgggacggcgggcctgcgggatgaccggcgcgggccgcgtcccggtgggatcgtccgccgatccggcgccgctgaggcgggcggtggccgggcgcagggcgagcgcggcggcgtagccgaaagccagggcgaccgggagccagaggggcagcatcaggcggtcatactggcttttcagcgggtgcgccgcgaccatcatcacaccggtcagaccggtgaagatccagagcggggcgtacgggcgcatcttgatgatcaggacggcgaccgcgaagccgaacgcggccagggtggtcggcacggtcagctcggccttcagctgggtgggccagaagtccaggtcacggtcgatcagccagctgatcgggtggggcacgtccggcttcgcggtgaagtggccggtggcgtagtcctgaatggtgtcgttcaggctcggcaggtgcagcagcgagctgagcagctgccagccgagcaccgcgacggcgccggtcgcgaccaggatcaggctggtccggcggtgctcccggcgcagcgcggccagggcgccggcggcgagtagggccagggccatcgccatgccgctggccgagcggaaggcgaacagccagaccagcgaggccgcgatgatcgcgaaaccggaccgccgcccgcgcagcaccagcatgccgccgatgatcgaggcgagatagccggccatgacgccgccctcggtcagcatccgggtcatcaggaagccggtgggcagcaggaacatggcgacggcactcagcacgccggccagccgcaggccgctggccatccagacggccaggtacgccagggtggcggcgagcagggccagcaccatggtggccgccatcatgccggtccaggcgccgagaacagccacgaacgggctggcgaacagcggatagcccgggcggctgtcgaagatcgcgatgtaccgcggggagatgccggccagcgtgtactcgacgcactcggggcggtgcccgttggcgaccagcgaccggttgatctcccggcagatctgccgggcggcctcggtgtgcgcctcctgcttggtcagcccggtgtacatcagcgcctgccgcatgtaccagaagctgtcaccgctgacgatcttgcgaggatcgttgtaccgggcgaggaagagcagcgagaggatgaccaggagcagagccagccacgccgtttcgacgagcccgcgcctgcgccccggccggctcgtgcgggccccggtttcggttgtcacggtgaacacctgatcttgtgggatggggtggcggcaacagtggacgatccacactgtcggcgacaagataccgcaacgcgaaaaacctgcacgatccccggtgtgggcgacgggacggcacccggccggagaccgggcaccgtcgtgccgcctacaggtagggccgggtgatcagctcgatggcgtgaccggacgggtccttgaagtagacgccgcgcccgccgtgctcgttgttgatctcaccggggcgccgcatctgcgggtcggcccagtgcacgatctcctgctcgacgagccgggagtacgcccggtcgaacagctcgtcgtcgagcaggaacgcgtagtgctgcatctggatctcgaccggcggctcggcgaactgcagcagcacgccgtcggtgagctgaaggttggcgaacgggccccaggacggggcctccgggatctccagcaggtcgcggaagaaccgcgccgacgcggagcggtcccggctggcgatgatggtgtggttgaaggaagcgggcaagtgactcgacctcacgatacgttcggatggggcgggacctgggcgcgcgaggcgcgggaggtccgcgggccgaacgtggggcggtcagctagccaccgggtcgccgatccgtgcgtggcgcagagccggtccggtgttcacggtggacgatgctaccggacaactcctgcaacgtcacgcgcagcgcgtgcaactcgtccgcgacggccagcacggcgtgcgcgtgcgcggccgcgatcaccgtcgccgtgccggggagtttgccctccagactggccagcatctcgctggcccggccccggtgcgtcatggtgctcccctcgcggtccgcttcgctgacacgcctatgagtcttggcccatccggatcgcgcggtccggtgttcggccagattcgcccggtcgatgccatcgacgacgttcatctgcgtccatcttctcgacgcgtgccggaaaggttccgcgggttgccgggttcatccgttgtgcggcgcgccggtggctaccctccggcgtgggaggcacgggttgaccatcgaatacgcggctcagcggacagggcttcccgctgggcggcaatgagaacgaaccggaccggccccggcggatggggcggctcagcagccggcgggcgttcgggcacaacggctcgaacgcctgcctcggctgggccgacccggaccgcgggctggtcatggcgtatgggatcggcccggcctgcggggagtgacgcaggcccgtggaggcgagctaggcctgtggggtgggcagggcgatcacctggcgcaggttgacgtggcgggggcgggacaccacgtacgcgatcagatcggcgatgtcgtcggcgcgcagcgccggcagcagctcgaacatgccgcccagctggccggcgagctccgggttgtcgatgtggtcgcccagctcggtgccggtcaggccgggctccaggttggtcacccggaccatctcggcgcccagctcggtgcgcagcgacgcggagagatgggtgagcgcggccttggtcgccgcgtacaccgcatagcccgggaaggtcacgtgcgcgccgatcgacgacacgttgaccaggtcggcggggcggccggcggccgcggcggcccgcagccccggcaggaaggcgcggagcacgtgcagcgcgccggtcagattcgtgtcgatcatccgggcccactcgtcggcgcggccgtcggcgatcggattgggcagcatcacgccggcggcgttgacgatcagatccacctcgccggccgtcgccgcggcggccgtgaccgcgtccaggtcggtgacgtcgaccggcagcgcctgagcccggccaccgccggcgatgatcttggcggccaggtcttcgagccggtcacggcggcgggagagcaggaggacgcgggcgcccgagacggcgaggagctccgcggtggcggcgcccatgccgctggcggctccggtgatgacggcggtgcgatcccgcaggtcgtaggtgttcatgcggcccagcctggaccggtttccgcgcggtaggcaggggtgcgtcgatacggggatcgccgttgcctaggactgacagaaccaggctccgatgtgctcgccggggcagaatggggccatgaacggggaggcggaaatcggggcgttcctgcgggcacgccgggcggcgatcaagccgcaggacgtggggctgcccgcgctcggccgacgccgggtgcccgggctgcggcgcgaggagctggcccagctggccggggtcagcccggactactacatccggctggagcagggccgcgggcggaacgtgtccgatgcggtgctcgacgcggtcgcccgcgtcctcgggctcgacgagaccgagcggcggcatctgcaccgcctggcccggccggccatcgcccccgtgcgccggcagcgggtccggcccggcgtgcgactgctgctcgacatgatggagacggtgccggcgttcatcctcgggcggcggatggacgtgctcgcgtggaatgcgctcggcgacgcggtcaacgggttcagctcctggccggccgaccggcgcaacgtcgccaggcaggccttcctcgacccggcggcgcgcaccttctatccgcagtggaccgaggtcgcggccgagacggtggcgttcctgcagctcgacgcgggacggcatccgggcgacccgctgctggccgcgatggtcgacgagctctccggcgccagccccgagttcgcccgtctgtgggccgaccgccgggtcaaggagaaggcgtccgggaccaaggtcctgcggcatcccacggtcggtgagatggccctgggatatgagacgctcaccctgcccggcgagaccgatcagatgctggtcacctacaccgccccgatcggcagcccggcccacgacgcgctgcgcctgctgaccagctggaacgcacccacccgggcggtcgcatgatcggttactgtgccgggcatgcgattcgagccgggtcaggtcatcattcggcggtatcggcgcgggccgtggcgcacgtgggcgcagccgatgcgggtgatccgggacgatgacgcggggctgctgctctgggcgcccgagggcggcgacttcgcccggctggtcgatgtggacgggcggaccacccgcgacgtgagccccgacctgatgcaggatccgcggctggcccggcacacctggcgtggcaacgacgtgctgatcctgatgccgcccggcgccggatactcggtctggtggttcttcgtcgccggcgggttcaccgggtggtacatcaacctggagaaaccggcggtccggcaggaggacggcgtcgagaccaccgacctggtcctcgacatcgtcgccgacccggcccggaactgggagtggaaggacaccgacgagttcgccgagctgaccggccatccgctctacttcgacagcgccgaggcggccgtgatcgaagccgaagcagcccggctgatcacgctcctcgaggcgggcgacttcccgttcgacggcaccttcaccggtttccgccccgacccggcctgggatccgccccgcctgaccgacgcggcgatgcaccggtgatcgacgtgcgccccagctccgcctgattccgcctcgccggcgcggcgaggcacggccaccggtctgccggttctcggggctgccggcaaccggctacggcgcgggacgacccggcccagccgagacccccgacgggcgccgcgcccaggagcagcggtggactttctccacgaaagcggccgcgacgtatcaaagggcgggcatacctgccgcgaggcggtgtcggacccctcgcttaggatgcgcgccatgcggggtgaggcgggggcggcggttctgccgttacgggtggcgaccgcgggggaatcgctggacaacgcggtggcgttgttgcggcggcgggccctgccgctgctggtcatggcggccgtgctggcggcgggcgagcaggtgctgctgcaccggctgcggacggggctgtatctgcggccgccgttctactggccggacatgggctacgacccctattacggctatcgcgggcagccgggcgccttcggcgtctggtggcaggtggtggcgaccgggctggcgaccgaggtgctgatcatcacgttgttgggggcgtatgcgggggccgccgcggggccggccctggtcggccgctcggtgaccaaccggggggtgttacggcgtacgccaccctggtccgccctgctgatcgcggtcgtgctggccgcggcggcctggcccctggcgtacctgggcctggtggggttgatcgtgctttacggccttttcgggctggccgtgccgatgctggcgttcgacggggtcaacccggtgcgcgcggtggtgcggtccgggcagttgtcggtgcggaccggggcgcgggtggcgcgggtccggattctgggctacctgacctggctgggcatccgggcggcgctcggcttcgggtggatcgcggtggccggcatgctggccgtcaacgtggccgacgccggctggctggactgggtcgtcccgatcgcctgggggatcgcgaacacggtggcctacgccgcgctggcctgcctcgacgcggtgctgctggtggacgcccggatccggaccgaggggctggacatcgcgctgcaccgcgcccgggcgcgcggcgaggatgacgccgccgtggtggcgggcgcgcgatgaggggctacgacgagttcgtcggccggatcttcgacgtggtgccgggccgggtcctgctgctcatcctgatcatcgtggcgggtctgaccgccgccctgtggtactggtatccgtcctgggtgccgcgccggatgccccggatgccccggctgccgcgcttccggctgccgcggttcccccgctggcgactgccccggttccggcggcggcggagggtcaggaagaaaccggaccccgtgcggccgtcgccggtgcccgacgacgacccggtggccgatgagccacagccgatcggcggcctgtccctggccgaccggttcgccctgcaggggcggtatgccgaggcgatccgggagcggctgcgtgacaccgtccgcgacctcgcccgggccggcgtgatcaccccggagccgggcgccaccgcggccgagctggccgcggccgccgcggtgcgccagccggtggtgagcgcgccgctgggcggcgccaccgagatcttctccgagatctggtacgggcggcgggaggcctcgccgggtcacgacgcccggatgcgtacgctcaccgacgaggtccgtgccgccctcaccaccgtgccgggagggccgcgaccgtgaccgtcaagagacgccgcctgcgcgtcgtgatcccgctggcggtgctgttcgcgctggtcgccggcaccctgatcgtccacgcgatcgagcagcccgatcaggacgacagcgacttcctgtcgccggtcagcagcgccgggatcggcgccgaccggctcgccggcctgctgcgcgggcgcggggtcggcatcgtccgggagaccacctcggacgaggcgatcgccgcgctcgccggcggggacgccaccctgttcgtcaccaccccggcgatcgccgacctggcccggatcagcctgcccgacggccgggccgggatccggatcgtcgtcgtcgcccccgagcaggcgcagctgaccgcgacgccgtggccggtgcgggtgcgggattcccggtggaccaccgaggtcgccagtcccgactgtgccgatccgctggccaccggcgccgggcgggccggcgtgcacggcctgcgctacacctccgcggcggcgaccagctgctacgacggctcgctgctcgacgtgccggccgggcaggccgcggtcaccgtgatcggggcggccgacccgttccgcaacgaccggatcggcgagcacggcaacgaggcgctcgcggtagggctgctggcacgcacctcccgggtggtctggctggaccagcaccggcgggacaccccgccggcaccggccacgacgccgaccgacgaggacaccgaggacccgtacgccgcgccgccgacccgggagcgggagaccgcccggcccgaccgggcgccgcggcggaccccggcgggtcccggcggtggcggcgacgatgaccaggcgcggggcggcggcgagccggacccgctgttccaggcgttcccgccggccgtcttcgcgaccgtcctagctagctaggcgctggccggggcggccgcgcgccggctcggcacaccggtcagcgagccgttgccgtcccgggtgccgtcgaacgagacgatgctcgggcatgcccggctctaccagcgggcccgggcccgcgacgagtcgctgggcctgctgcggtccgcggcccgccggcggatcacggcgcacctgggcctgccgcccggggcgctgctcgccgacctggccgagcattccggatacgacgaggacgacatccgcgagatcctcgccgacttccaccccgacaacgacgacgagctggtctcggccgccgccgccgtgcagaacctggtacgcgagatcaccggatttgaaggagaccagccgtgacccccgatgcccaagaagcccgcctcgccctgggccggctgcgcgccgaggtcggcaaggccgtcgtcggccaggacgcggtgatcggcggcgtcgtggtggcgctgctctgcggcggccacgtgctcctcgagggcgttcccggggtggccaagacgctgctggtgcgcaccctggccgccgccctcgacctggacaccaagcgggtgcagttcacccccgacctgatgcccggcgacgtcaccggctcgctggtgtacgactcgcggaccgccgcgttcaacttccgggccggcccggtcttcaccaacctgctgctcgccgacgagatcaaccggacgccgccgaagacgcaggcggccctgctggaggcgatggaggaacgccaggtcagtgtggacggcacggcccggctgctgccccagccgttcctggtcgccgccacccagaacccgatcgagtacgagggcacctacccgctgcccgaggcccagctggaccgcttcctgctcaagctcgtggtgccgttgccggaacgcgacgccgagctgaacgtgctgcgcgcccaccaccacggcttcgacccgcgcgacctcaaggccgccggggtgagcgcggtggccggcgccgccgacctggccgccggccgggccgcggtgcagcgggtgcaggtcgccgacccggtgctcgcctacgtcgtcgacctgtgccgggccacccgggtggccccggcgctggagctgggcgcgtccccgcgcggtgcgaccgcgctgctggccgcgtccaaggcgcacgcctggctgaacggccgcgactacgtggtgcccgacgatgtgaagggctacacgttgccgaccctgcgacaccggatccggctgcgcgccgacgccgagctggacggggtgaccgtcgagtcggtgctggccgccgtcctggcctcggtgccggcgccgcgctgatgatcaccaggcgtttcgccgggctgctcgcggccggactgccgctgccggcgctgctgccgtcgccgtggctgggactggccgtggtgctgatcctggccggcgggctggccctggccgacctggccgtcgccggcccgctgaacgggctgcggctgcgccgcgacggcgaccgcacggtctggctcggccacccggccaccacccggctgaccgtcaccaacacctcggaccgcaccgtccgggtcggcctgcgggacagctgggtgccgtcggccggcgccgggccgctgcggcacagcctggagctggcgccgggcggggagggcacggtcaccacgacactgacgccgacccggcacggcgaccggcccgcggtgcgggtcaccacccggtcgtacggaccgctcggtctcgcctaccggcagcggcgccgggcgttcaacgaccggcagaccccggcgtggacgctgcgggtgctgccccgcttcccgtcccgccggatcctgccggagaaactcgcccggatccgggtcctggacggcgccgtggtcacccgcggccgcggccacggcaccgagttcgacgtgctgcgcgagtacgtgatcggcgacgacgtccggtcgatcgactggcgggccagcgcccggcatcacgacgtggtggtccgcacctggcgcccggaacgcgaccggcgcgtctactgcgtgctggacaccggccgcacgtcggcggtccggatcggcgacgcgccccggctggacaacgcgatcgacgcggccctgctgctgtcggtgctggccgcccgcgccgacgaccgggtcgacctgctcgccctggacaccgagatccgggtccgggtcgagggcggcgggcaccgcacccagctgccccggctgatcgacggcatggcctcgctggaaccggccctggccgagaccgacttcacgctgctgggccgcgagctgctgcgccgggaccgcaagcgcgccctcgtggtgatcttcacggcgctggacaccgccccgatgatcgagggcctgctgccggtgctgccgcggctggccgcccggcacaaggtggtggtggccggggtgcgcgatccgcaggtggcccggctggccgcgctgccggccacgccgaccgccgcggacgtgcacacggccgcggccgccgagcgggtgctcgccgaacgggaccgggtgcgcgacgtgctgggccggtccggggcgaccgtggtcgacgccgacgcggccgacttcgcgagccgggtggccgacgtctacctgctgctcaaggccagcggccggctctgagcgctcaggcggtcggcaggtccgcgtggtccgggccggccggcgcccgggcgtccgcccgccggccccagagcagggcgtaccagaggaagccgagccagaccacggcgccgatgccgacccggaccacggccggcagcccggacggggtgacgaacgcctccaggcagccggccaccgcgagcgccaccaccaggccgaccgcgatcaccatgccctcccggaaccagtcgatcagcgactggcggcgggtccgggacggccccggcgcgatccacgcccagccgatccgcagcccgaccccggcgccgacgaacaggcaggtgatctccagcaggccgtgcggggccagatagatcaggaaggtgtcaccggcgttgcggctgaccatcaccgcgccgagcaccccggtgttgagcaggttgccccagagcaggtagagcaccggcaggatgagcaccccggcggccaggcactgggcggtcagcagcgcgttgttcgtccatacctgcagcgcgaagttctgcgcccggtactcgctgtagtagctgacgaagctgcggccggcgatgtcctcgatctggtcgccggagacgaaggcggccagcgcgtccgggtggtcggccagataccacaccatcgccgcggtcaccgtgaccagcaccacgcccaccgtgccccaccaggcccgggtccggaagagcgcgccgggcaggcggtaggcgaagaagtcggccagcggtcgcagggagaagccgccggaggtacgggtcaccgcggcccgcccggccagcaccagccgggacaggtcggccagcagcaccggatcggcgttgcggctgcgcagcgccgacaggtgggtggccgcccgctggtagagcaccaccagctcgtccagctcgcccgggttgaggtccttggcccggccggcgagcagctccagccgccgccactcgccgccgcgctcggccagatacgcgtcgagatccatcatgagttctgccgcccccgccggttcgttgtgcggaagcgtagtggacgctgtgcgggtgacagcagcagccaccgacctggtcaccgccgaggcggtcgccctcgacctgcgcccggcccggctcggttcccgggccatcgcgttgggcatcgacatcctggtgcaggcggtcatcgccctcgtcctgtccatggtcggcagcgcggtgctggccaccctgccggagagcatcgtcgacgacgcgctgtacgcggcgacggtgcggatcgcgatcgtgctggtcctgctcggctatccgacgctggtcgagacccggaccaacggccgcagcctcggcaagtcggcgatgggcctgcgggtgatccgcgaggacggcggtccgatccgggcccggcacgccttcacccgcgccctggtcggcctggccatcgagtggcccggcctgctgctgccgttggtgacctgggtggtggcgctggccgtgatgctgttctcggcgcagggccggcgtctcggcgatctcgcggccggcacgatcgtggtgcacgagcggcggccgatgtcgttccgtttcgtgccggccatgccggtcggcctggccccgtgggcggccgggctggacctggccgcggtcgacgacgagctggccgggcaggtgcggcagctgctgtcccgcttcggtgacctggccgagccgcaccgcaccgcgctgatgcacctgctcgccggtgaggtgggcgcccgggtgacgccaccgccaccgccgggcaccccgccgtactacttcctggccgcggtgctcgccgagcggcgccggcggtcggccgcgtcgctgatggccgggcgcctggtcaccgagcggctgctgcctggtttcgggcggttcgtgcaggccgcgccgcggctggtgcgccccggcacgccgcccggcgggtcgatgtgaccggggtgcggctggagccgatgaccgaggaggagtaccggtcgtggcgggccgacgcggaggcgcactacacccggagcgtcatcgcgtccggccggtcaccgcacgatgcggcccgtttcgccgccgacacctatcagcggttgctgcccggcggcttcgccaccgcggacaaccatctctggtacgcccatgacggtgaccgccgggtcggcttcctctggatcaaggtggagcacggcgccgcgttcgtccacaacgtggctgtcgagccggacctgcgccggcagggtcacggccgggcgatcatgcaggctgtcgagcgctggtgccgggagcgcggactgacccggatcggcctgcacgtcttcgcccacaacaccggcgcccgcgccctgtacgaggcgctgggcttcgtcgagaccggccgcaacctcgccaaggatctctagaacaggccggccggcaggtcgagggccgctccggcgaggttttcccgcaggtgggcgaccgacgacgtaccgggaatcagcatgatgttcggggagcgccgcagcagccaggcgagcgcgaccgccatcggcgtcgcgccgaggtcgtcggcggcccgccgcaactcggcggtctgcagcgggctgaagccgccgagcgggaaatagggcacgtaggcgatgccctgcgcggccagcgcgtcgatcagcggatcgtcctcccggttcgccaggttgtagaagttctgcacgcagacgaccggggcgatggcctgcgcctcggcgacctgctcggcgctgaccgtgctcagccccaggtgccggatcaggccctcgcggcgcaggtcggcgagggtgccgaacatctccgcgatcgagcccggctcgggccggtcgaagccgccgacccgcaggttgaccacgtcgagggtgtccaggccgaggcggcgcaggttgtcgtggacctggtcgcgcagctcgcgcgggctgcgggcgtgcggccagccgccggtctcgtcgcggcgggcgccgaccttggtgacgatgtgcagatcgtccgggtagggggcgagggcctcgcggatgatctcgttggtcacgtgcgggccgtagaagtcggccgtgtccaggtggttgatgcccaggtcgacggcggtgcgcaggacggcgatcgcggcgtcgcggtctttcggcgggccgaagacgccgggcccggcgagctgcatcgcgccgtagccgaaacgggtgaggtcgaggtcgccgacgcggtagcgcccgccgggcaggtcgtggttcatgccaccaccatgccgcgcggcgccgccggtagggaggacccggtcatcctgggaccggcagggccaggcaagcggtccagcctcctaggatgcgtgaggcgccgtgacgggcgtgccgccgcccgggctgcgggaaccggccacgcgacactgcaccccgctctagccggtgacggcctgttccagccgcacgtccacggcctgtcgggcggcccggccaaaggcgtcgccgccgtcacatgattgccggatccgcccgggacgcctacgcggcccggtgcgggctgccaggatcgtgaggtggacttccggcaggcagcggcggacgggcggcagacggccgaggcgctcggggcgctgcaggcctggctgctcgccgaggacgcctatcggcgtggcggggtgcccgacgaggtgctccagttccttcaggaccatgtcggccacctgctcgggccgcaggcgatggccacggcccagatcttcctgcgcggacacgctgactgggccacgcccgcgcgggaccgggcgctgctgctggacctgctcgcggagatcgagggcgcgcgccggcccggcttcgagttcgggtggtacgccttcgggccggacggtgcggacgacgggccgacgacgctgctggtgatggcggagtacggcgtccacgatccggtgtgggagcggccgcggggcagcggctcaccggtgtcgctggccgatcacggcgtctcggagtcgctggtgcggcggctgcgggcgtggaacgagacgttcgagcggtacgggacccgcgacgaggatcgggcggacgacgcgtgggccgccgagggtctggcgctggcgcacgagttgcagcgggagctgccggacgtggaggtccgctactaccacggtgacgacgaccgtccgctgcgcgacgtggtcaccggggcgtcctgaccggcccggcgtcggtcaggcccggggccacaggtcccacggggtgcggccggggcggaagccgaaggcgtcggccatcgcggtggcctcgcggaaaccgttggcgaccagctcggggcggtgcgcgtcgctgccgaagctgaccgcccggccgccctcctcgtgccaccagcgcaggatggtggcgtccatcgggatccgggtgttgatctccagggcgcggccggactcggcggtggcgcgcaacgcgtaccggaaatcgtcctcgaacaacgccgggtcgaacggcccggacttctcggcgggccaggagcgcagcggatagtcgatgtgcgccagcacggtgaacgggtcgtcgccggcgaccatccgggggatctcggcgaggtactcgcggaccagggcggccgggtcgcggtgcgggaacagcgcccacggctcggcgaagccggcgccgtcgggcaggcagtgcagcgagccgaggacccggtcgaaggtgccggccgagaggatcctggcgcactgctcggcgtaccagtgcggctcgccgatctccagcccggtgaggatccgcaggccggggaagcggtcgcggcagcgttcgacggcggccaggtagccctcggcgtcgaaggcgggcgggtgcaggatgccgtcggcgtcggcggcggcggtcagctccgggctcgcgtacgggccgtcgaccgggaccggccagctggtgtggtcgacgtgctcggtgaacgcgagcgcgggcaggccgatcgcgacggcccgctcgcaggtgccctccatcgacccgacccgggtgtcccaggaccactcgctgtgcacatggctgtcggccggcaaggtcatgcgcaccaacctatcggtgtggcgccgccggtaccggtgcgacccgggtgaccgccgccgcggtgctgcgccggcggctgccggcgacggtcagggccaggcccgcggccagccagcagagcagcacggtcagtggccgggccgcggcgtgcccgtcgaagaaggcggccgagcgcagcagggactgcgaggcccccggcggcaggaactgcccggcggcgccggaccacccgggcagcatctcgggcgcgctggtcgccccgctcagcgggttgcccagcagcatcagcaggaccgcgccggcgccgaagccggccgtgcccagcagcgactcgaagcccaggatggtcagtgccggtgcgcccagggcgagcgccatcaccgcggcgttggtcaggtagtcaccggtcagcgagcccagccagtactgcaggatggcggtcatcgcgaggccgccgagcgcggcataggtgagcgcgccggcgatccgccgggtggcgccgtcgacgcgcaggctgagcagtactgcggcgagcatgccgccgaggaccatgggcagggcggcggcggccaggccggcgccgcgggcgtcgtcggcgggcagcggcacgatgtcgcggaccgggggagcggccgatccgctgagggccgcggcgacaccctgtagggcctgggcgacggccgggctggcggccgaggcggtgagcacctgcggggtgccgccggtgaggtcgatcgcgccgtacacgtcgcggtgccggatggcggtctccgcggcggccgtgccggcgacggtggaaaccgtgaaggcgcccgggcggttgtcggcgacggccgcggtgacccgggccgcggcggccgggggaccggcgacggcgatcgggatgtcgtgcaccgcggcccgggtggcgggccaggcgaacgcggtcagcagcgcgctgatgatcaccgtgagcagggcgacggtggccaggacgcgcggccaggggctcggtgcggtgttcatgccggctcctacaagagaacgatcattcgttttagagtttggagcccctcgtgccgccgtgtcaagaacgatcgttcgttttatggctcaggccgcctccgccggcgtgatgctgcccagcaggtcctccggatgcaccggccggcacaggtggtacccctgccccaggtcgcacccgagcatccgcatcgcggtgcgctgtgcctccgtctcgatcccctcgatcaccgtgcgcagccgcagcgtccgggccagctcgacgatcgtccggatcaccgccatgtccgcggtcgtcgggatctgcttgctgatgaacgcccggtcgatcttcagttcgtcgaccggcagccgctgcaggtaggacagtgacgaatagccggtcccgaagtcgtcgatcgacacgtccaccccgaggtcctgcaggtcgcgcaggcaggcgatggccgtcttcgggtcgctcatcagcaccgactcggtcagctccagggtgaccgcctcggccggcagccgggtgtcgctgagcatccgctccacgtccgcggcgaactgcggatcggtcagctggcggcccgagacgttcacgttgatccccaggtgcgggcgggtgcggcgccaggccgccgcctgccgaccggcggtgtgcagcacccaccggcccaggtcgctgatcaacccggtctcctcggccatcggcacgaagtcggccggcgacacgtacccccgctccgggttctgccagcgcaccagcgcctccaccccgaccggctcgccgctgtccaggtcgatcagcggctgatactgcagccggaactcgcccagcgtcagcgcccgctgcagatcgccgttgagggtcagccgggccagggcctcggcgtgcatctgcggctcgaacagcaccaccttgcccgggccctcggtcttggcccggtacatcgccacgtctgcgttgcccagcagctcaccgggcgccgggccggggccggccgcgatcccgatgctggcgccgatgaacacgtcctgcccggccaccgtgaacggcttcttgatcgcgtcgatcagccgctgcgccaccgggacggcctggtccgccgggcagtcggcgagcagcaccgcgaactcgtcgccgccgatccgggcggccgtgtcggtcggccgcaggcagccgcgcacccggccggcgaccaggccgagcagttcgtcgccggcccggtgcccgaggctgtcgttgaccgccttgaaccggtccaggtcgatgaagagcacactggccggcacgctgccggccagccgctcggcgagcatctcgaggaacagcatccgggtcggcagaccggtcagcgggtcgtgccgggcctcgcgcagcgactcgatcagggtgagccgctcggacgcctcccgctcccggtcctcgcgcagcgaccgttccgtggtgagcaggccgatgttggtcagcgccaggcccagcgtctgcgccatcgcctgcagcagctgccgctcctccgggtccagcgggtcgccggcccgggccagcagcagcgtcccgcccggcttcgccccgaaccggacggtgctcacgtgcagctcaccgatcccgggcacggtcagcatcgccggccgcgggtcaccgtccagcagggactgcagctgctcgcggctcgcgccccaggccacctcgacccggccgtcgcgcagcaccgccccgatctcggtctccagcacctcggcagcccgttcgacggcgaccatgatcgcggagtgttcctcctgcggcgcgcagaccgcggcgaagaactcggtgagctgatgggtcgaccagtggttcatcgtgctgtccgttctcaggccagggccagggtgaccagggtgaagtggtgcatgccgagggcgccacggacccgggcgatctccccgttggtgtagaagccgccgtacggcacgccgtcgagccgtttgccgatctcggcgttctcccgctccacccccgcctcacccagcttgatccagcgggccgcgcagtcgaacaccagcatgcccagcgccgggaccccgcccagcgcgtcgagcgcctgcccggccgcctcgccggccccgtcgagcagcgcgtcgctgtcgctctccatcagccagaccagcgcgccctgcggcacgtcggccaggcagagcagcgaccggtcggtccggtttccgtcgtggatcacccggatgtcctcgccgctgcgccgggacagccccagcgggtggtggaacgccagctcccggaacccggccgggtcgtcgagcgcggactcgtccacgcccagccggcgcaggaagacgtccagggccggttcgccgtcgagctccagcacccgtccgtcacggctgctggtcaccaccagcgcgtcgccgtccttgcgccagccgtgtgcgatgcccaccccgagcggccgatccgagccgaccgccaccccgaccaccgcgtcggacaggatcgccaccccgtcgcgaccgccgtggaactggtaggtccgcacatacgtcaggtcgtccccggcgcacccgccgaccagcgggatcgccgcgccggccaccgagaaggcgccgcgcacgatttcgtgctgggtgccggtcaacccgtccccgatcatcagcaacgcccgatgctccgcatcgatcccggccagtgccgacgcggcccgcgctcccgactcccggaggcggccactcacgctctccgacacctgggtacggacggagaaccccgccccgccccacgccgtcatggccaccccggcccgactcacccgcccctcggccaactgccccgacgtcgtgcagccgacgatcaccgtggccggcccggcctgcgcccgcagcgcgtcgaacagctcgggcacctggtagccgaccgagcagaacacgaacacgacggccggcacccgcccgcccagcgcgccggcggccgcctccgccccggccgcggccggatcgctcagcgtgctgtgcccactgccgaaccaccgctccccaccgatgccatccgtcatgcccgcagacatcggccgccggtcgcccgagttgaggtgcgcgcctagagtcggccgatgagctccctcattcgcaacgtctcgttcgatgcggccgacgcgtacgcgctcgcggtgttctggtccggggtgatcgggcatccggtgcacccggaatgcgcgcccggcgatcccgaggtggtcatcgagccgccggacggcccgcggctgtacttccagacggtgcccgagcccaagcaggccaagaaccgcgtccacgtctgcctgaccccgcgggacggggggcgcgacgcggagatcgaccggctgctgcgggccggcgccacgctgttcgccgaccaccgcaccccggacggcgcgggctgggcggtgctgcgcgacccggccggcaacgagttctgcctgacccgctccgccgctgaacgacacagttgagcatttttcaggttttgtcggatctgtcgacgggtacaagatcactacacctccggtgcgggccccccaccggcctcaccgtggcttcgcccgtcttccggaggtgtagtgatgaagaacgttctccctgccgccctgctcaccgcggccacgtccctcgccgccatcccgcacccggccctcgccgccgcaccctctccgatcgccgcgccgtcttccgcggccgcgcggtcttctgccgccgcgccggcagtgtccgccaccgcccaggtctacgacgaggacagccgcctgctcgccgaagcccgcttcgacgccccggccgacgccttcacggtgaccaagcgcatcaccggcaccgaacgcgcctacctggaataccgctacaccacgccggccggggccgtgcagaccggcacccaatggggctcccgcgcagccggcgaaaccctccgattccggcacgacttcgccaagggccgtcaggtcaccttccgcgtctgcctggagggcgaccaccccttcaacccctgcagcggcgccgacaacggcgagaactggaccctggccatcgcctgataagcccgccgcccgactgccaccgggcgcggagaaactcgcgacagtcgtcgccggccaccccgcagttgacccagcggtcagggcgggcggcagcagccagttcggcgccggacagtgcctcctccggtccggcggcgcgggcgacgggcacgttctcgaactcgaagccggccggaggtggcggcaggctgggcaggtcgccgaatcggggatcgccgaggctctgccggcgatgcacgacgaccaggaaaccctccccggccgggcggacgctcacccatcgcacggtttcgtcatcggcgctgagaaactgctcgacctcgccaccgcgccgcagagcaccgacagcgaagttacgggtcagataccgcattcaaagaacttaacggctcgccgtcgtgctcggcggtccagtggccgacgacgcaggcggcctccggggagcctctgctcggttaccgcggaccagtcggtccgcttgatggcgacagtctggtcgccaggcctccggggccgggccgcagggaggagaccggggcatggcagcccgcacccggcgcgcccatcgccggcggacttccgggatagggtgctccggtgcttgtactgaccggcgccgatgtggaagctctgtgtgacctggacgcgctgacggcggcgatggccaccgccctgcgcgagctgagctgcgggcgggcgcacctgccgccgcgggcgagcctgctggtggacggggccgggctcctcgacatgccgagctggattccggcgctgggggcgctcaccaccaaggtggtcagtgtgttcccgggcaatgcgggcggggatgtacccgtacggcaggcgatgatcgtcgttttcgatccggagaacggcgtgccggttgcgatgatcgatgccgggtggctgaccgcggcccggacggcggcctgctcggcgctgtcggtgcggctgctggccaggccggacgccgcggtgctggcgatcgccgggaccggggtgcaggcgcgggcgcacgcggtggcggtgagccgggtgcggccgttccgggaggtgcgcgtcgccggttcgtcgccggaccgggccgccgcgctggcggaggagctgtccgcggtgctgcccatgcgggtgcgggccgtcgccgaccatcggacggcgctgcgcggggccgacgtggtgtgcggggcgagtttcgcggtgcggccgccgatccgccgggagtggctggcgcccggcacccatgtgacctcggtcggctaccggctggacggccgagaggtggacgatgcgacggtggccggggcggcgctgttcgtggagtcacgggacgccgcgctgcgcgccgtgccacccaccccggatctggcgcagccgctggccgccgggctgatcaccgccggacacgtgcgggccgagctgggcgaggtgatcgccggaaccgcgcccggacggctcgacgacgccgagttgacgctgtacaagtcggtcggtgtggcggtgcaggacggcgccgcggccgcgctgctcctggccgcggcccgcgatcacggccgcggtcaggagatcaccgggttctcgccgatcgccggcaccagtacggcgaagtcgaaggcgtccgcggccggcagctcgatgtagccgtcgagattgcggaaccggcgcggtgcctccggtgtgccgcgcagcgggcgcagatcggtgatccggacgccgtcgtgggggagcagcgcctcgaggctgcccgggaccggctcggcgaggtcgacggtgagcacctcgacaccgctctcggtacccggggcgggccgccgggtcggagttcggcccccgccgcaggtgaccgcgatcgacaggtagtcgtcgcccaggtcgccggccaggtgaccaccggcgaccggcacctcgaaggtgccgcccaggctgatcggaatccgctgcaggtgggtgttggccgcggagatcaccaatcggccgccgccggccagcaggtggcgggcggtggctgccatcgccgcgtcccgcacgttcaccgcggcgtggacgcccgacccgccgaccgccgcgacctgcgcgcgcagcatctggtcgagcaggcccgccaggcgcagctcgtgccgggcggtggcgaatccgtccccggcgccacgtcgcgcgtacagcgggcgcatcgcctccatccgggtggcgagttcggacagcaggatcgtcagcgcgtcccggtccgctggcgggacggcctggtaggcgcggaacgccaccagggtgtgcgggctggcccaggccttgccgtacgtccggatccgatcaaccagctgggcggcggcggggtcggcttcggcgagatagcgggccaccccgtcgatcgccgggagcagggatccgagctgagccggcaggtccagaccggcgaaccgaacatttcgcccggtgcggtggtgctcgcgaagccagcggatcagtcgccgcgtctccgcggtgcccccgaacccgtaggtcagcccccggtccgtcacgtcgtcggctgcaccggcgcgatcttccacggcgacgtccgggtgcacatcgctcgctgcgtcatggtcgtcatgggcagtgctgtgcgcgccggcgatccagcggccgaccgcgaggccctcgctgaagccggactccagcgccacgtcggtgaagcccatccgctccaccaggaaccgcaccaaacgatgcctgacctgctgatactcccggacgttgtgcgccgactcgccgatcccgaccacccgcgccccgccgacgagctcgcggagcggctcaaggtcgtcaaggccggcgtccgggtccagagtggacagaagcatcgcgcgggctccctcgcgtcgtggtgatccagcgccctcggccgggacctgacgaccctaccgtcaccaccaacaacctagaatcctaggatgctagagaggcggtgcggcacgccgccccgagaacggatacgacggcttcgccgacaaccgaaaatcaacgatcacattcattcttttgtacggtgttccgggcccccaaccgcagagatcaggtcccgttggtgcgcggcgaggtcgcggccacccgggatcgctgggcggcatccggggcgtgtcgccgggtcgaggcgggccgcccatctcctcgcgccgccgttttcggtcacagccagtgcgctccgtagtgagatcaggcgcttgttcaccggcgcggcggggtgcgcagacctaccaccgggcggctgcggcgggccggggctgagtgcggactgcagaggcttgccgggcgatcgggctgaaagcggcccgcgcccttccggggcgggtgagcgctgccggaaaatggtcccgggcgagtgccgggttgtcgcggccggccggtggtgccggcttttcccgggccgctgatcccggcgtccgcacgcaccgaaggccatcgacgcaggtgatccgaacgccgggtggaaccttgccgccgtcgtcgaccgggccgtggtgcgcgacgtcagtggtcgggcggaaccttgtcgccgtcgtcgaccgggccgtggtgcgcgacttcaggggtcgctgtcgtcgaccgggccgtggtgcgcgacttcaggggtcgctcatttctccgcgtcgatgatgaggaattccgggtgcgggtggcggaggaagtcgtggtgggagatgtcccagccgtaggcgccggcccggctgaagatgagcaggtcgccgacgcggaggtgggcgacgtgctggccgcgggtgaggacgtcgcggggggtgcagagttcgccgacggcgtcgatctcggtgtcggtgacctcggggcgggggtaggggcgggtccaggactcgatcggcaggatggtgaacgggtggctgtagccccaggcggcgggcaggcggaagtggtgggtgccgccgcggagcaccgcgaaggtgcggccgtgggtggttttcaggtcgacgacctcggccgcgtagaagccggcgtcggcggccaggaagcggcccggttcgaggatcagttcgaggctgtcggggacggtgaccgtggacagcggggcgaggtcgatcgaggtgtcggaggtgtagtcgattcccaggccgccgccggcgttgacgacgcgcaggtccaccccgtaccgggaagccgtcgtcatcgaccaggcgatggcctgcgtgaggaaggccgcgtgcgctgcgccgtcgaggttgttggagacggcgtgcaggtggaatccgatgacggtgagctgtggggggagttcacgcaggacggtggcgagctgattttcgtcgatgccgaacggggtggggctgccggtcatggtgtggctgccggtgaccgcgacggtggtgcggttgatgcgcaggcagatgtcgccgcggaagcccagggcggccaggcgccgggcttcgaaggggctctcgacgttgatcagggcgccggcgtcgatggcggcggtgagttccgcgtcggtcttggcggggccgccgaagacgatgcggcgggcgccggcgtggcgggccagggtgagttcgccgccggaggcgacctccaggccgtcgcaggcggacagcagggcacggacgacgtccgggtggccgttggctttgacggcgtagagcagggtggtgcgcggtggcagggcggcgcgcaggcgggcggcctggcggcgcagcgtggtggtgtcgtagaggtaggcgcagaccggggttggtcgggcggtgagcgcgtcggtgatgtgcgggggcggctcagccatgcagggggttctccaccgggaggtagatgtcgccgttgtcggcgagccgcatccggacgagggccttgtgcgggacggtcggtgcggtgagggcggcgtggtcggcgcgggcgtccggggtgtccagagcgtcgtaggtttcgtcgacgacgtcgcggatgatccgccaggcgtcgggttcgtcgaggtcgaggtgcaggacgagttcgccgaggtgggcctggaacgcggtgtagccgagtttggcgcgcatgacggcggggtcggtggtgccgacgacggagtcgggccagaggtcgacgtcgtggccggcggcggcgaggcggggcaggtgcaggcgcaggccggcgaagtcgcgcagggcgagccggtggggccggccgtgcaggaaggtgggcaggcagttctgcaggtgggcttcgatgccgacgccgtgggcggcgaggcggagcagtggggggagcaggagccgggtgtagtcgcgcagccaggcggcgggaccgccaccgtgccgggtgagcaggccggggagccggtggggcagggcgctgccggggatggcctcctcgccggggtgcaggcggccggtgaggccgtcgcggacgatggcggacaggtcgcgtccggtgccggcggggacggcggcgccgtgggtttcggccatcagcagcagggtgggttcgccggtggtgaggcggtgcaggagggcggagacggcggggccgttgcgggtgctggcgacggagatgctgcggcgggtggaggtgatctggatgtcgagggagaccttgaggtagtggcggcggccgtcggcggcgggtgggagcagcagggtgcgcagggcggcggtggggacggcgtcgaggtggccgtcggccgggcgcaggacgccggcgtcgaacaggtcgcggtatcggtggcggacgaggtcgtgctgccaggcgtggacgggctgcagccggaaaccggacggtgggcgcgggatggcggggtagtgcgtgctgaggtcgtcgccgaggtgggcgtcatcgcggacggcgatgaatcggatgtcggtggatccggattcgaggtcgtgggcgaggacgtcgcaggtgtcccagccgagccgggtgcggccgcaggggtgcaggttgtgtccggtgacggcgagtcgttcggcggcgatggcggcctcgtcggcgtcgccgccgggggccgggccgggccgggccagtgcgaccgccaggttgatcaccgcgttgcggatctcggcggcgaagcggggtgcgtcgatgccggtgagcaggtccaccgggtcggccacgccggagcgggcgaattcgatccggtggaacgcgtgccgggtggcgccgggtgcgtcgtcgtcggtgaggccttcgcgggcgagggcgccgcgcagtcgccggccgacggtgtcggcggcccggggcaggttgtcgaggaagccggtgaccaggtcgggtgcgtgtacggcgagggcggcctgggtgtgcgcggcggccgcggcgaggcggccggtggtcaggctggaggtcatgcgtacaccgccatggggttgggctggtggatccagatgtcctgcagcgggtcggcggccaggcgcatcgcggtggtcgccttgatcgggaggggttcggtgagcagggcggggtggtcgcgcaggccggcggcgacgatcgcccagaggcggccgggttcggcgccgtggtgggtggcgaaggcgtcggtgagctgggtggcgacggtgccgagggcggccgcggcgagtttggtgcgcagtgcggtggggtcgtcggtgggcaggtcgccgtgcaggtcgaggccgaggcgccggtcgacgcggacgccgccgaggtcgcggtagaggatccggacggggtgccggtcgcggagtacgaccagggtgttctggccgtgtgcctccagggcgacgccgcggctcagcagggtggcgagcggggtgaacaggatgccggtgagggcggtcagccaggtgtacgggtcgtcgacggtgtgcaggaagcgggtggcgaaaacgccgagtggcacggcggtttcgccgggggcgaggtggggggcgcggcggatcaggtgggcgaggcgccggtccggtccgtcctcggtgatcacggcgccggcctcggtctcggcgaggatgtcgatgggcaggtcggcgcagaggcgggtgagggcctcggagaggatcggcccgttgtgcacggcggccgggctgaccgtgcgtacggcggaggtcatctgcacgtcgacggcggttttgaggtgggggccgccgctgaccggggcgacggtgcgcagcgacatcagggggcgcatcgggcgggtcgggccggcgtcggtgagccacgggtatcgccggagcaggcgggcggcctgccaggggtgggcgtagaggacgggttgcccggtgccgtgccagcgttcggcggggacgcgcaggcggcgcaggcggatcaccggccggtgttcgggggcgtaggcgaggacgtcggcgacggtcatcccggcgcgggtgcggcagcacgggtgccgcgggtgtccgtcggtgtccagctgttcgacggcggcgaggtcggtgggcagggtggccggggggagcgcgtcggcccgggccagggccaggttggcgacgctgttggcgatctcggtgaccaaggtggtgcccggccacagtttcgcggcgaggtcgaccgggtccatctcggtgtaggtggcgccgggcagtggctcgcggtcgatcgccaggcgtagccggtgcagcacggcggcgcgggctgcgggcagtgccgcgtcgtagcgttcgaccaggtcgggccggaggttttcgagctcggcgcgggtctgggccgggtcggcggtgggggtcggctgcggcacctcgtcattgtcgcgtcgcgggggcgcggtgtggctcgcgggtgggtgccgggcgagcggcgacacactggtgacgcgcccatcggagaaaatccgatacattctcatatcttcaacgagcgggaggtcatcgtggacacggatgtcatcgtggtcggcgccgggctggccgggctggtcgcggcgcgtgaggtgaccgccgccggcaagcgggtcctgctgctcgaccaggagaacgcggcgaatctgggcgggcaggcgtggtggtcgttcggcgggctgttcttcgtcgacagcccggagcagcggcgcgcccggatcagcgacagtctggagctggcctggagcgactggcggggcagtgccggcttcgaccggctcggcgacgaggactcgtgggcggtgaggtgggcacgggcgtacgtcgagttcgccgccggcgagaagcggtcctggctggccgggctgggcctgaggtggctgccgttcgccggctgggctgagcgcggtgacctgcgcgccggcgggcacggcaactcggtgccgcgcttccatgtcacctggggcaccggcaccggggtggtcgagccgttcgtcgccgccgcgcaccggtccgccgaggccggcctgctcgggttccggcaccgccaccgggtcgacgagctgatcgtcgaggggggcgcggtcgtcggcgtacgcgggaagatccttgctccggacgagggcgcccggggggtggcgtcgaaccgcgaagagctgcaggatttcgaggtacgggcgcaggccgtgatcgtgacgaccggggggatcggcgccaaccacgatctggtccgcgagtactggccggcccggctgggcaccgccccccgggagatgatcaccggggtgccggcgtacgtcgacggccggatgctcgcgatcgccgaggcggccggggtgcgcctggtcaatcgtgaccggatgtggcattacaccgagggcatccgcaactgggcgccgatctggcccgggcacggcatccgggtgctgtccgctccgtcgccgatgtggttcgacgcgctcgggcgccggctcccgcagccgtactacccgagctacgacactctggggacgttgcgctacctgcggacgacgccggaactggccgagcacgaccactcgtggttcatcctcacccagaagatgatcgagaaggagtgggcgctgtccgggtgcgagcagaacccggacgtgaccgcgaaggatcgtcgggcgttcgtgcgcgagcggctgtttggcaagggcgccccggcgccggtcgaggcgttcaaggagcacggcgccgacttcgtggtggccggcacgctcgacgagctgatcgccgggatgaacaggctgaccgaccggccgctgctggacgccgcgcacgtgcgtgggcagatcgaggcccgggaccggcagctggccaacaaggtcaccaaggacgcgcagatccagggtatccacaactcgcgccgctacctcggcgacaagctcggccggacctcggcgccgcaccgggtgctcgacccggcggcgggcccgctgatcggcgtcaagctgcacatcctgacccgcaagacgctcggcggcatccagaccgatctggactcgcgcgccctggccccggacggctcggcgctgcccgggctgtacgcggccggcgaggtcgccggtttcggcggcggcggtgtgcacggctacaacgccctggaggggacgttcctcggcggctgcatcttcagcggccgcgccgccggccggcacgcggcccgatccctctgaacgctcagcgccgtcgatcggttcagatgcggcggcgtgattcgcggtcgccgcacagttgcgcccggcacccgtccacgaccgggccgggcggggttcaccccggtgaccgaccacggaacgggggactggcgatggcggacacggcgcccgggctcggccccgacctgcacccgggtgccgcccagtccggcgcggacgacgacggcctggtccgggtccggctcggaccggacggccggatgctgtcgctggaggtcgacgcgcgctggccggaccggctgcccgggccggaggcgctgaccgcggcgatcctcacggcgtaccgccaagcgctcctgaaacgcatggcggcccgcctgctcaccgatccggcggcggcgccgctgccggacgtcaccgacgcccactggctcgccgggatccgcgacgccctggacggcacgctgcgccggatctgtccaaccggcccggcccggcaccccgccggcggagacggcgcatgagcgcgatccggggtgctcgcgatgagctgctcgactgcctggcccgggaggtcggcgcggtcgccgtcgcgcacccggtgcgggtcgccgtggacgggccgcccgcggccggcaagacgacgctcgccgacgaactggccggcgtgctgcgcgccgcgggccgcgtcgtcgtgcgcgccacgatcgacgacttcctggtgccccgggcacggcgctatgcgcggggcgagttctcgatggaggggtgctaccgcgacgcccacgaccacgatgcgctcaagcgggtcctgctcgacccgctgggcccgggcggcgaccggcgtttgcgcaccgcggtccacgaccacggtgcggatgcggtgtgctgcccgccgccgtcgccggccccggccgacgcggtgctgatcttcgacggtgtcttcctgctgcggccggagctggtcgaccggtgggacctgcgggtgctcgtgacggtgtcactcgacaccacggtggagcgggccctggtccgggagcgggagaaggcgtcccgggcggcgatcgagcggcggtggcgggaacggtacatccccgcgcagcggatctacttccgcacggcgcatccggtgcagcgtgccgacgtcatcgtccacaacgacgatccgcggtgcccggcctggcaggtgcggcgggctccggggtagatggcctcgaaggcgggacagaaggctgaaatccggcaagaccgcctggacgacggtgcgggccgatgccttcgacgcgaagaccggcgactcctgcgactcggtcccggagctcacggtcggtgcccccggcgaggcgccggccgtcaccttcgccggggacggcggctgcgccgacttcgtcgtgttcccgctggtcagcggcaccgacatgcggtagtcgcccggccgggtagccagctcatcgtcggcggcccggccgccgtgcccgcaggccggcacccgccaggacgacgccgatgacgacaccggtcacgaaggccgccggcccggaacgggccgggcgttgcaccggcagacgggacggctccggcgcgggcgggtcgaccggcggcggttcgggccgggagtccggcgcgatgtacatcgtcgccgtggtgagcgcgagcaccagggcgcagaccgcctggagcaccaggatgaccgtcgcgaggtgtgccacgccgttccgggcgtccggggtgtccgcggtgaagaaggtcatcacagcgaagtagacgcaggtgagcacgtcgccggcgaccccggccggcgtggtctgcgcgatgcggaacgcgtcgtaccgagcgccgtggccggccgagaagtagaagatcatgctgccgatgagcaacgagtagagcacggccccgacgagcgtcttcacctcggcgaagtaggtgccggcacgctcgcgttcgacatatctgctggccccgtggaagcccaggccgtaggagccgatccgcgcatacgacacgcaggcttcggcgtagatggcgatcagctgcagcgcgcccagccccgccgagatccaggccagcgtggtcaccgggccgtgcacccggttccggagagcgggcgcaccggtgatcaggaggaaggccgcgacgtacacaccgatcgccgtgaagtcgtagaggatcgtccggccgaacctgatcgcgacgccggccgctctgccgcgtcggctcgcgaaccgcaggagccggtactccagcactccgaacggcggcaccgcccggccgttgcaccggtcgagcacctcccagtaggccgcctcggagaaggtgtcctgccgtttgcgcagctcgacgatgaactcccgcccgttggcgaggatccaccggatcgccgagagcaccccggagaacttgacgatctgcaggagcagcagcaccgatccggcgacgaggagaactcgctggaggctcaccgcccgcctcctcccgccggcatccaggtgcgcgacggttcgatcttcaccgatcggggtgccccgcgcaacggccggtcgtgcccgatgctgggacggtgatgatcgatgaaggggcggggatccggcggccgcggctggcgcaggcgccgccgcgggtgcggctggccgtgcgggagatgctgggcgggccggtcgtcgcggaacaggcggcggatgccgggttcaccccctcgatcgcttcggtggtcaccggcggtgacgggaggcggctgttcgtcaaggcggcgccggtcggtgacgggctcggtgaggcggtgacggccggggtggtcctggccggggtgaccggaccggtgggtccgcggctggtcggctgcgcgtcggccggacggtggcgggtggcggcctacgaggtggtcgacgggaccgctgtgacctgctggcgggccgctgatctgccgcatctgctgcgggtggtggatcggctgcggaagatcgcgcagccgtgcccggtggtcggtgtcactccgtacgccgaagccttcgttcctcttctcggtacctggcgagcgctgaacggggagggtgacggcggggtcgcggtcgatcatctgcgcgggcggccgctgccggtcgagctgccgatcccgctgctcgccgggctggagggggactggctcgacgcgctcgctgccggcacggccctgcatcacggggacctgcggcgcgacaacgtcatccgggagccgggcggccggcttcggatcgtggactggacccatctgtggacggcgccgggatggctggatctggtgcggctggggccggacctggcgatctgcgggcatgatccggagcggatgctgcggcgttcctgctggcgggacgctccggcggacgcggtggacgtggcgctggccgggctggccgggcgggcctggcgagagggctggctgcccccggtcccgggcctgccggggctgcggcgcatgcaacggcgtcagggcctgcacctgctgcgctggctggcggcgcgaaggcggcgcaccttgcctccgccccttgcgcaatgacaagatgtcacgcatgcagttgcgggatgactatctcagtggcagtgcgctggccgaacgtgggtggacgccggcggcgatccgccggttcctgggggcgccggaccggacctcgccgagaccggggttctgccgggagcgggtggtcgccgcggagcagtcggagccgtggcggcggtggcgggccggggcggtgcgccggtcctagctagctagcgcgatccgcaacacggtgtacgcggtgatcgccgccgcctacccggagctggccggggaggcgcgccggcaggtcgccgagcacgccgcggcggtccccgcccgcccccgccggtcccgcgccggccaccggcggtgacggcgcgccggtcggtccttttcgggccttgcgggggtacgcgatgagccggtgccgtcggatccgtcagtcccgttgcgcctcccgacggatctgctcgatcgcggtcacggccgcctgccagccgaccgtgacgtccggggccgcgtccgtcccggacagcagcggtgcgagttcccggcacatctggacgagggcggcccgggtgcccgtcagccaggcccgcgcgctgctcaccgcccgccggtcaccgccccggccggcgccgatccgacggtgctcggccagggcggtggcgagcgtctcgcggtagcgggccaggtaggcctccggggtgccgccgagcgccgcttcgaggtggtcgagcaccagcttcgggtcgcgcaccgggtcaccggtccgcgtcccgaagtagtggatcgccgcgaggcaggccgcgagccggcggtggacggtctcggcgacgccgagcgccgggcggcgctcggcggcatccagggactccaccagcaccggcgcccaggcgcgggcgccgggctgtccggattcggcgcccagcagcgcggcctgcccgaccgagatcaccgcgagccaccactgcgggtcgtcgggcaggtcgtcgcgccggatcaggtcccgcatggtcgcggcggacctgatccggttcacctcggcgaagctcgggacgctcatcagttcggcgcgaacggcagcagccagtcgccgtcgcgccacgagctggggaacacgtcgatgcccgcctcgtggaatttctcgacgccgaggtcgatgagtccgtcggtcggctggaagtgaccgctcgaatcgttgatctcgacgccgaacaggtcgtcgatgtggccggtcccggctgcccggagtttgcctttcagcccggccaggacggtgtgtgcgatctccacccggggccagccgctgccggtggtcccggcgaaggcggggatcaccttgagctcaccgtccatcgtgatcccccatttgaagtatccctcggtgccgggcgacgccttgctgatcgcgtccttgagtgcctgcagcccgctgcccggcccgatcgtaaccgggctgaccccgcgtttggccgccgcgtccaattcgatcttctgcatgccctcgtccctgaggttgggcaggcagttgtggacgaggaccggcgtggcgccggccagcacgtagaaggtgtgcagcgtcgcgaccgtgaggttgtgcatgatccggcggccggtgtgctgctggacggcggtgacggtcgccggcccgccgcgcccgagcagggtgtcgccgggctgcagggccccggcgtcggtccactgccgggttcccgcgttccagaacgggtggtgtgcggtggtgtgcacggcctggtcgccgtgccggccgccgatgcggacgtcggcgaacgcggtgtccaggttgcggtgcaggtcggtcaccggttcggcggcggtcaccccggtctccgggtcggtggccaggaccaggtcgccgacccggacggcggcgatcggcaccgcgcggccgtccgcgagcagcacccgggtctgcggcgtgaagctgtcgcccaggcatttcttgatcagatcgtcgaggccgtcgaggatgcccttgccgtcgatcaggcccttgagtgcgtccgcgacggccgggaaccccttgacgtcgatggcgagcttgagggcactcagttcgtccgcgctgaaggtgatcttcttgggcaggtcgacgttgagctcgatcagcttcgtgagcttgagcgcgccgagtttcttgagcgccgcgtcgatcaggtcggcgccgatgttcttgaggccgttgagcagctcgccggagagcagtttggccaggcccgcggcgatgccgtcgcgcagcacgtcgatcgccgcggtgatcttcccgatcttcggcaggtcgagggtggccaggtcgaccacgctcatgccgagcgccttggcgtagtccccgttgcgccattcgtccaggtggatgagggagccggggtggtcgatgagctgcttgacgccgtccttgagcatgtcgcaggcttcttcggagtccggcgtgttgcccggggtgttgccgggggcgccgaacgcgcagagcccggagagccagaggccgccggcgatgccgagcacctcctcgctttcgccgcggtagaacttcttcagccagtcggggaggtccttggcggcgagcttcttgtcgacgtagtcgcgccaggtctgcatccaggaggtctggcgggccttcttctccgcctcggtgagatcggcgagctggtgcaccgcggtgtgggtgtcggccgcgatctgcaccatccgggcggcggtgttcttcatcgcggtggcgaaggtggtggccgagtccgacgccgccttgatctgcttggcgatcgagtcggcgttgtcggcggcggtcttcgcctggttggcgtagttgcgggcggcgcccgccgcctgccggcccacggcggcgtcgtgtccggcctgaaccgccatgccctcggcggcgttggcgtaggcggtcgcctgctgggcggcgtgtgcggcgtcgttggcggccgccacggtggcgcgcgcctcggtggcggcgttgttcgcggcggtgatcgcggccttgctcgccttgatcgcccggctggcgtcctcggcggctttctgtgccgcggcgtaggcgggcttgacctgttcctgcgcccgcagcgcctcctcggccgcgtgcaccgcggcggcctccgcgtcggccgcgtgctgttcggccgcggcgctctgttcggcgccgatcaggatggcgctgttcgcgacgtcgatcgccatctgcgcgtcgttgtcggtggccgcgtactggtcggcgacgctgagcgcggcggcggccgggtcggcgatcgcccgggccgaggcgcgggcgtcgatggcggcccgcccggcgatccggctctggaacgcggcgatgccggcttcgcgcagcgccgagtcggccgccgagctggtcaggtcggcgtcggctttggcggcggcggcccggttgatcgctagctagctagcgccgggcagctgggcgccgatgatcgcggcctgttgcgcggcgtagtcgccctcggcggtgcccttcttggcgatcgcgtcctgctggtacgcctcgtagctgagctgtttggtgtcgcggtcgctgatcgccttctgggcgcgcagggaggccgccttggagtcgttgaccagagtgtcgaaccggtcgatcgacttggtgacctcgtcggccgcggccttggcggtggcgcccttgccggccgcgacgttctgctgctcgaccgcccggcgcgcggcgtcgtaggcggcggcctgttgggcgatcgcgatcgcactctgctgccgggcgatgtcgcgctgggtcttggcccgggtgtagtgctcgcgggcctcggcggcgcgggaccgggcgtcgcgggcgtcctgttcggcgcgcagccgctgctggtgcgcgtcggcttcggcggcctgggcggcggcggcgagtttctcggcctgggcggcgagcttcgccgccgcggccgcttcccgttcggcctcctgccggtacttcaccgcgttgttcgcatcgacggtggcgtggtggtcggcgtcgagcgtcctggccgcggcctcggtggcctcggcggcatggcaggcggtcgcggcggcctggccggcggcgtcggcggcgtcgttctgcgcctgcatgaccgcggcccagtcgacgccgtgcgtcaggccggtggtgaccagggtgtcggcggcggtcttggcgacgccggtgtgcgcggtgacctggccggcgttgcgggcggtggtggccgactcggtgcaggcgtcggtgcgcagccgagtgaggtcggcggtgtgggtggcgccgccggctgtgcggatcggcaggtccgcggcgtagacggcgtcggcctgcttggcgtatttgtcggccaggcccatcgagttcgcggccacggtcagcgcctgggtggcggtgacgctctcggtgatgatcgtcgtgcgggcggtggccgcctgggtggcccgccgggcgagcgcggtcaggtcgtcgacagccttggtgcgcgcggccagcgcggcctcgatctgctgctgcgcggcggtgtcgcgggccgcggccgcggcgtagccggtggtgtagaacgcggcgatcgtcgccgggtcctcggtgtcgagggcaccctggccggcccacctgacctcgtagccgccggcggcgacgatctgctcgacccgcgccttgatcgttttggcctgctcggccgcggtgatccggtcctgctggtcggccgcgaccgcggcggcgtgcccgaccgcgatgaagtccgcgatcctgtcgtcgttcccggtggccagcgccgcggccgccttctgccgctcgaccgggccgccggtggcggcccagtcctgcacgatctcccggttctcggcggcgtcgcgcgtgcgacgttcggcggcggccgcccggtagaccggcaacgcgcggtccaggaacggcgcgaactgggccgggtcgccggcctgcagcacctgcgcggcggcggcccggacgtccgggtccgcgtcgtagtcggcgaggtcctggatcagcatccggtcgagttcggtgtcgtcgatcgggccgtcggccgcgagccggcgttcccggtcggcgtcggcggccgcctcgcgggcgatccagtcctgcagcgtcggggccgccgcgggcggcacggcctccggtgtgatcggtacggcggcgttcgcggcctgcggcagcatcaccactgcgagcaggcttgcgacgaccgcggcgatacgtgcgcgcgtcatcccgttgttcccccgtgttgatgatcgacaagtgtcgatgcgttgcttctgtcagtcgtaccagaagcggggcgttcgtggggggcccgggaacgggaaaacgcccgggccggcgtacggcccgggcgttttcgcggtcttactgggtgatgcggatgtcgtcgatgtagccgcggtagccgccggtgccggccggctggtcgtagccgaggtcgatctgggtgatccgcttgccgttcgcgatcgcgccgagcggcacgatcacctgggtccacgtgtccagcggcagtttgccgcactgcttgaacgggtgcacgacgttgccgcgggtgtccttgacgccggtgtcgcgcagggagaccgtggtcgccgcgatcttgtcctcgagcagcaggtcgagcgacacgcaggagctgttgctgccggtcaccccgccgaacgaccgggtgctctgcgggtagatccagtaggacagctgggtgctcggggtcacgtaggtctcgccgaggctgtaacccttcatgtacgcgtgcgagctggtggcgctggtgtccttgcccgagtagagcacgacgttcgagccggtgcggccggtggccggcccctccttgagctccggaccggtgacgctggcgacgatcgggccgacgttgagcgatccgccggccggcttggcgccggtgtcggcactgttggtccaggtcagcttggtgtcaccgggctccgccgaggtgcggaacttcggcgcgctctccaggtcggagaacgacaggtcgtcgatgaagccacggtagccgccggtgttcgccgcctggtcgtagccgacggtgacccgcaggatcgtgcgtccggccgcgaccgcgccgaggtccacgtccacctcgttccaggtgtcgagggtcagcttgccgcactgcgcggccgggtggaccgagttgccgtgctggtccttggcgcccgagtcacgcaggttggtgccgtccgagaagatcaggtcgaccgccacgcaggagctgttggcgccggacacctgagtcatctgcgccgagctctgcgggtagatccagtacgacagcttggtggtcggccgcaccgagacgcccttgagcccgaacacctggttgtaggcgaacgacttggtggcgttgttgtccatgccggagtacatcagcgcctgcgacccggtgtgcgccttctcggcgcgcacgcccagctccgaagtggtcaccgagttgacgatgccgccgacgttgatcgtgccgccgtgcccgttgccggtgttgtcgaccgtgttctgccagttcggccgggcgtcggcggcctcgaagccgctgccgaagtccagccggcggtccttggcgcgcgcctcgtcctggcccttgagcaggaaggtctgcagggcgaccagggtgttggcggccagtgccgcctgggccgcggcgagcaggttcggcgagaagccgtcgtgctcggcggcgtcgcggatcgggatgacccgggcgtggtagccgtcgcgctcgatgaccgcggcggcgtcctcgtcgcgcttgttggcggcggcgccgccggtgaagatgaagtcggtcagcgccttgtcgagctggtcgtcgggcgcgttcagggcgacctgggaggccagggagacctcggagcccttggcgttgttgtggacgaacagcacgaactgccggttcggcgcgctgaccagctcgtcggtcacctgcagcagcaggagctgcagcagcgacttcttggcggccaggagctgcgcggcccgcagcttggcggcctgctccgcgtccgccttggcgatcgcctcgcggatgtccaggtcggccgccgcggccgcgccggtgttcagaaaggtgtcccagtcggcctgggtggtgccgtcggcgatcgcggcctgggcggcatcccggacgtggctgccggcctcgacccgctgccagaccccgaagatgaagtcgcggtcgttgcgctcgatcagcgcggtgtcggacgggtcgagcccgacggtcaccgcgaccgagcgccggcgggcctgcgcggcggcctcggcgatcttggcctgggcgtcgtcgttggcggccacgaagatgccggtgacgatgaagtcgtacgcggcgtgcgggtcgtcggactcgtacgcccgcagcgcggcggccttgacgttcgtgccggcctcgtcgcggcgccacagcgcgaagacgaacgcctggtcgttgaggacgagcaggtcgacacccgggttgacgccgatcgcgccggccgccttgaccttgtcctcgtcggtggccaggttcgtcggatcgtccaccgtggcggcggaggccttggcggcccgcacgccggcggaggccgacggcgacggtgacggggcggcgtgggcggctcccggcacacccagcagcccgcacaccaggccggccgcgagcaggccggcctggacggttctcacagacatgacgattcttcccccatgaagatggccggtcccgcggtatgcgcgccccggccgtccggtccggacagtcgccgggcacgatcttgcccacagcgacgggcgcaaatatacggcaccgccgctcggcggtgtgtccggtgggacataccgcacaggcccgggccggccgccggagcggcccgcccgggcccgggagtgcgtgatgcgggggagtggggtcaggccaggttcagcgcgacctcgacgttgccgcgggtggcgttggagtaggggcagacctggtgggcggcctccagcagcgccgtggcctgctcctcggacaggccgggcagctcggcctcgatggtgacgttcagcccgaagccgccgctggggagctggccgatgccgacgtcgacggtgatcgcggtgtcggtcagcgtgaccttctgcatgctggcgacccgcttgagggcgctgtggaagcaggccgcgtagccggcggcgaacagctgctcggggttggtcagggcgccgcccgggccgcccatctccttcgggatggccaggtcgaagtcgaggacgccgtcgctggagcggacgtggccgttacggccgtcgccggtcgcggtcgccgaggcggtgtagatcgcggtcatccggggatgcccctttcgagggatggtcgactcagccgcgggcgcggatgagcaggctgtgcaactgggtgagctcgtcgacggtcaggttgaccgagcagagcagggcctgggtcagatcgccgatcgcgtcccgcagccgcaggccggagtcggtcaggctgatcaggacggtgcgttcgtcgtcggccccgcggacccgggtcagatggccctgcgccgccaggcgtttcagcagcggggagagggtgccgctgtcgagccgcagggtgcgaccgagatcacgcacggtagtggggccgtcgtgccagaggacgcgcagcaccaggtattgcgggtaggtcaggccgtgcgggtcgagcagcggacggtagagcgcggtgatcgatcggctggccgcatagagctggaagcagatcatctcgtccagtgccgtgctctcccgcatgcccagaaaggtagtgggcaatttagttgtgcacaactgattggtggcgaccgtcaccaccgtgtgtgatcatcgcgggatgccgggcatccgattcgtgaagcttccccccgccgccctcagcgccctcatcgacggcgacctggccgccgcgagccacgccgccggtaccccgctgagccgctacctgatcgacgaaagctggctgtggcgcatccggctggaggacgtgcgacgcgacccggaggccgccgactggatcgcccgggccgcggtcaccgacccggacggcgtcgtggtcgggcacggcggcttccacgggccgcccgacgccgacgggatcgtcgaggtcgcctactccgtcgacccggcacaccgccggcagggccacgccaaggcgatgctgcgcagcctgctcgaccgcgccgacgccgacccgcgggtcaccgccgtgcgggccagcatccgcccggacaatctcggctcccgcgccaccatcaagggcttcggcttccgcaagatcggcgagcagtgggacccggaggacggcctggaggacgtctacctgcgccccacccgctgatcagcggtccagccggaccaccagcggccggtgatcggacaccgccggatgcggcgtgcgaacctgcaccacccgacccagctgccgcccaccgcgcggatcggccagcacatgatcgagctgggtgcgcggcgacggactcggaaacgtcgccgcccgcgccagcggccgccacccggagaacgcgcggaccggcccggccggcatgttcagatcacccagcagcacccgcggcgccggcagcgcccgcatcgcccggaccgcgtgccgcagctgccgcacgttccagcccggcacgaacgacagatgcgtggtcccgacactcatcagcccgtacggcgtctccagcaccgccgcgagcagcacccgcggctcgtccttgagcagcagcagcccctccggggtgagcaccggcgaccggatcggcgcccccggcagctgggtgatctgccactgccgcaccggaaagcggctgaccagcgcgatcccgtactgcggatgggcgatgtccgcgtcggcatgccacggctcccaggtctgccccggcgtgccgaccaccgccgccgcgaaccggtgcgcgggcgcccccagcgcctcggcgcacaacacggtcagatccagcccgcccgaccggggctgcgcccggtcgacctcctgcagcccgaggacgtccgcgtcgagctcgccgacagcgtcgcggacccgatcggcgtgtaccgtgccgtcggacagtgatctgccgtgcaacaggttgaacgtggccaggcgcaccggcccgaccttagtcgatggaggctggcatgttcatcaaggccctgtgctgcacgatgctgatcttcgtggccggcgcgatgctcggcatctggctgcagcgggcgcgcggccgcaagtgatcgtcctgcttttggtggcggccgcggcggccgggtgggtcgacgcggtcgtcgggggtggcggcctgctcctgctgcccgcgctgctgctcgccgcacccgggctgccgctgccgaccgcgctgggcaccaacaagctcgccgcgatctgcggcaccggcacggccgcggtcacgtacgcgcgccggaccaagatcgactggggggtcgccgggccctccgcggcggtggcgctgatctgcgccggctgcggggcactgctggccggggcgatcccggcaacggcgtaccggccgatcgtgatgatggtgttgatcttcgtggcgatcttcgtgaccgtgcggccggccatggggctggccgagcacggggagaaacgcacgccggtgcgccgggcgctggccgtggcgaccgcgggcgggctggtcgccgcctacgacggactgatcggtccgggtaccggcacgttcctggtgctggccttcaccacgatcgtcggcgcggacttcgtgcgcggctcggcgatggccaaactcgtcaacaccggcaccaacctcggggcgctgatcgttttcggcgtcaccgggcacgtcgactggctgctcggcgccggcatggcggtctgcaacatcggcggtgcgttcctcggtgcccggatggcgctgcgccgcggctccggcttcgtccggatcgtgctgctgatcgtggtgctcgccctgatcgtcaagctcggcgtcgaccagatgagaatgggctgatgagcgacgagtcgcagaacctgatcgcggaactcaaggaccaggaacgccgcctggtcttcgaccacttcgacgaggccgacgcgtgggcgttgggctgcctgctggtcaacctcgccaccgagcgcagcctgcccgtcgcgatcgacatccgccgcggcgaacagcaactgttccacgccgggctgcccggctccaccgccgacaacgacgtctggatccagcgcaaggtccgggtggtctaccggttcgccgcctcctcctacctggtcggccgcgaactcgcggccaacggcagagagctcgacgccgcgatgggcgtcgatccgatgcggtacgcggcccatggcggggctttcccggtacgcgttgccggggccggcgtgatcggcgtcgtcaccgtgtccgggctgccgcaagccgacgaccacgcgttggtcctcgaggcgctggagaccttcctcgaccgatgagctctgccgtcggcagatccgtttggggccgggccggatcctcgggcaggctcgacccatgcggatactgattctcggcggcagcggattcgtcggccgggtcctggcggccaccgcggtggccgacggccatgcggtgacggtattcaatcgcgggcaccgcgacccgatccccggcaccaccctgatcaccggcgaccgcctcgccgacgacggactggccggtctggccaccgggacgtgggacgcggtcgtggacacgtggtcggctcaggcgtccgcggtgcgggccgccgcccggctgctcgccgggcgtgccgggcactggacgtatgtgtccagccgatccgtgtaccggtggctggcaccgcagccgctgaccgaacagaccgcactcgcggacgtcgacgatcccggatacgccggggacaaactgcgcggcgagatcgccaccgaggcgttcggcgggccggtgctgctggcccgcgccgggctgatcctcggcccgcacgaggacgtcggccggctgccgtggtggctgcggcggatgcaccgtggcggcccgaccctcgcgcccggcccccgctcgctgccgctgcagtacatcgacgtccgcgacctggcgctgttcctgctcgccaccatcggcgccgaggggccggtcaacgtggtcagcgaagccggccacgccaccatgggcagcctcctggacgcggcgaacgcggtcaccggcgggcacgccgagctgcggtggaccgacccggagccgatcctggccgccggggtgcaaccgtggaccgacctgccgatctggatgccgccgggggaggcccacgacttcatgcacaagggggacgtcagccgggccctggcggcggggatgcggtgccgaccggtgatggagacggtcagcgacacctgggcgtggctgtcggggctgccgggggcggcgccgttacggaccgatcggcccgcggtcggactcgatccggacgtcgaggcgaaactgctgtcggactgacggcccgcggtggtgcgtctcccgcccggatggccggagacgcaccggcggtcatccgcgttttcgcagggcgaaaacgccccagccgagatactcgcgccgatggcgcacgtggcgcagcgggtcggtgtcgagttcggcgcgcatccgcggggccagctcatcgtgcgggttggcgtccagccaggtccggatgttcagccaatgcgcggccgcgtaccggtcccagcagtcctgatcggccagcaccatctcgacgaggtcccagccgaggtcggcaccgaggtgggcgaccagttccggcagcgaccggaagtcgtcgcgggcctgcgcgtggcacgcctcgacggtctgctggtcgggcggttcccgtcgccagtacggctcgccgatcagcagcatgccaccgggacgcaggctgcgctccaggatctcgatggtgccggcgacgccgtggccgatccaggtggcgccgatgcaggcggccacgtcagccggttccggcgcgacgaagccggcggcgtcgccgtggacgaactccaccggaaggccggccgcgtgctcgcgcgcctccgcgatgaaggcggtgctgaggtccaccccgatgccgcggatgccgtgcgccaggtgccagctgcggagcagttcgcccttgccgcagcacaggtcgacgaggcggtcgccggcccgcagcttgatcgctcggccgaggacggccagcttcgcgggcgagaacgggttgagaatgcgaaggtcaccctcgcggatgacgtgatgacgggggatgtccatggcggagtgtcctgtctgggctcggtgcgatggcgaaggtcgtcgaggaatcgctacgcagcggcatcagatgcacccacactctccggtccggatttcggggtcaggctagatctcgtccggatgaccgggcaaccggtatatcccggtggtaatacagcgtttcatgccgatacagtgtatcggcatgagacctcgtatcgctgtggtgggggccggtcccggggggctgagcttcgcgcgggtcatgcatcaccatggccactgcgtcaccgtcctggagcgtgattccggaccggatgcccggccacccggcggcaccctggacctgcacgagggcatgggccaggtggcgctggagaaggccggcctgttgccggagttcgagaagctgtcccggcccgagggccaggccatgcggatcctcgccgcggacggcacggtcctgcgggactggcggccccgcccggacgagcgggccaacccggagatcgaccggggccagctgcgcgacctgctgatcgggcccctcgacgtgcggtggggacacgcggtgtccggggtcgttccgggggcggtgcacttcgccgacgggcggcgggaatccttcgacctggtggtcggcgcggacggcgcctggtcccgggtgcgcccggccgtctcgccggtgacgccccactacaccggtgtcaccgtggtcgagaccgccctggacgacgtcgacacccgccaccccgaactcgccgggctgatcggtgacggttccgtcggggcgtacggcgtgaaccgcagcatcgtcgcccagcgcaacagtggcggccacgtcaaggtgtccgcccgcttccgggcaccgctggactggcacgccggcctggatttgaccgacgccgcggcggtgcgcgcgacactgctcgcccggttcgacggctgggcggccccggtcctcgatctggtccgccgggggaccgcgttcgttcaccgtccgatccacgttctaccggtgggccatacctgggcccatggtcccggggtgaccctgctgggcgacgccgcgcacctgatgcccccgctgggcgccggtgccaacctggccatgctggagggcgccgagctcgccgaggcggtcgccgccggtccggaggatctcgacggggtggtccgaactttcgaggaacggatgtgggcgcgggccgggatgtgggcgcggatcacgacggccggcctcgaacgcctcgtcagcgcggacccggcggaagccgtcgcgcagttcgaccgggtcaaccaggattccggtgcccgaaccggtcgctgccctgctgcttgagtacctgggacagcgcacaaacctgcgcactgcgaccaaccgcgactcgcgctggccgttccccggccgctgggccggtcaaccgctccagtcccgcgtcctgtcaccgctgattcacgcgctcggcgtcccgaccaccagcggccgcgccgccgcaatccgtcagcacgtgctcaccagccccaacggccgggtcgctccgcgggtgcgctcggccggccactgccggtccgggtggaggccgatgccgcggcgtacggcatcgtggtgatgcgactcggcacgcattccgcgctgcgggaggcgatcgttctgtaccgggctgccggatacagctcatcgccgtaccgtcaatcggtcctggagaaaccgctcaccggtcagatgaggcggtcggcgggcggctggagaatgcagaactcgttgccgtccgggtcggccagaatgtgccagacccagccctcctcggcgatcggctgctcggtgagcaggcgggcgccgagggcggtgacgcgttccctctcggcctgcaggtcggggacgcgtaggtcgaggtgcagacgattcttggtggctttgcgctcggggacgcgctgcaggagcagttcgacgccgttgccgtcgggcgggagcaggcggcgataggggccgtcgccgtccgggccgggggtgtagccgaggacgccggaccagaaggcggtggatttctccaggtcgccgcagtccaacacgatcgccaggacgacggtggagcgcccgccgaatcgggccggtccgtgagtcaccctgacaccctagccggtttccaatcctagaatcctaggacgccttagaggcagtgcggcaagccgcaccaaaactcgaaaaggacggcttcgccgaccccggtaaattcaagagccgtgatgcttgagctgccggcgggctgggattgggagattcacaggtacgacggatggcggttgacattgatcggggatgtcgatctgacgtaccactggaaccgggaagtcatcttctgcgacgtcacccatctggcatgtccgttccagttctgcgacccgatctttcgcgagccgacgccgcgggaactcgcctcggtccgcgaggatgagccggcggtggtcgtggcgttcgacgtcgaggacatgccgtgcctgatcgcggccgagtcggtcgcgatcaggcacggcacggtgatgcgccgctagtgggcgtatttcaggccgacaacgccggccaccaccaggaacaggcagatgatccgggccggcgaggtgttctcgccgagcgcgaccatgccgacgaccgcggttcccaccgcgccgatcccgacccatacggcgtatccggtgccgaccgggatggtgcgcagcgcgtagccgagccccagcatgctgaggatgacggccacgccgaaaacgccggtggggaggagtctgctgaagccggcgctgcggtccagggcgatcgcccagacggtttcgagcagaccggagacgacgagaacggtccaggccatgacggactcacctcggtgaaggcggtcgtcttgtcgggccgggtacgacacgcatctcgtccggggcggccacggtcgtggcgccgtgacaaacggtagcaccggtggcaccggtggcaccggtggcggagcggccgatggatgcgggtgtgcggggcgtgtcatcatggcccgcctatggagacgtctactacctggcgagcgccgctgttgtggcggtttctgctcgcgctgtcccgcgtggtgatcgcgccggtgtgccggttgcgggtgtcgggttcggtgccggcggagttgcggtcggggccggtgatcctcgcggcgaatcatgtgagtccgttcgacccgctggtgttggtggcggcgtgtcaccgggtggggttggcgccgcggatcatgatcaccggtgggttgttcgacgcgccggtggtgggtgcggcgatgcgggcgtgtgggcacatccgggtggatcggggtacggcgcgggtggcggaggcgttgccggcggcggcgcaggcgctgaaggacggtgcgaccgtgctgctgtatccggaggggcggatcgggctggatccgtggatgtggccggagcggggtaagaccggggtggcgcggatggcggcggcgacggatgcgccggtggtgccggtggcgcagtggggtgcgcatcgggtgttgccgtatgaggcgccgacgcggatcgggcgggcgttgttgcgggctctgttcacgcggccggtggtgcgggtcgggttcggcgctcaggtggatgtgtcgggcctgtcgggttcggcgggtgcgcaggcgatgcgcgcgacgcggttgatcatggaggggatcgacgcggctctggcgccgctgcgggctgatgagatgcagttgccgcggtacgtcgatgcctctcgcccggtcgacctgtcgcgggtgcggcgcccgctctgatcgggggcgggtgttcgtggtcggctcgcctgccgctgcggtcggtgtcgtggcccggtggcaggatcggcggcatggtgaaggggcggatcgtcgccgagagtctgcgtccgggtgccgcgttggtcgtgcccgggctggagctggcgcgggtggcgcgggtggcggtggcggctcccgggccggggcagccggcggtgtggacgctgctggatgtggtggcgccggaggagcggtcggcggagttggcggcggcgttgagtgcggcactggctcccgacggtgggtggtatgcggatttccggtccggtggcgagcatgtggtggtgttcgccggccgggtgttccggtatgcggtgggtgatggggtggggcgggccgaggcggtggcttacgggcggtcgctcggggtgccgcgggcgcagctggactggggtccctgagggcgttgcggtctggtgggtgagggggcgtggtaggcggggtgttaagtcaccggttggcggtgcgggcggatctgccggtgctggagtcgctggtcgaggcggcgatcggggagttgcagaggggttttctcgacgaggggcagatcgcgtccagtcgggcgatcatggggttggacacggcgttgatcgacgatgggacgtatttcgtggtcgaggccgatgggcgggtggccgggtgtggtggctggagccggcgcgccacgctgtacgggggtgatcatcgcgcggggcgggatgcggcgttgctggatcccgtgacggatccggcgagggtccgcgccatgtacacgcatccggatttcgtccgtcgcggcatcgctcggttgatcctgtcgttgagtgaggcggctgcggcggcggagggtttccgtgcgtgtgagttgatagcgacgctgtccggggagccgttgtaccgggccgcgggtttcgttccggtcgagcgtctcagcgatgcttcgggtggggtggccgtccctttggtgcggatgcgcaaggctctttgatgccgttggccggatcgcccggcggccaccttcgccctcgttccggcgcatccggacggcatggcgcccggatttatcttgggatccgatttgtcagcgctgcgggcgtgctctcgactgaccggtggtgccggggccgcggctgcgggcttcggtggacggtctgcctgtctgagggtgtcgggggttaccagtcgcgccattggtcggtgagttcggcggggtgcaggcctcggcggccggccacggcggtgacgtcgacgccggcgccgacgaggacgtcgtggacgtaggcggcgagttgttcgcgttcgtcggtttcgatgtagtcgtcgacctcgttgagggcgagcacgacgcgttcgacggcggtccagatgtcgtggtcgctgctggtgggggagaactcgcggacgtcgtcctcgtaggcggtgagggcgaggtcgacggcggcgatgaagtcggggggccacagctcggccgcgtacgccttgtcgggggtgagttggccggcggtgatctgggcggtctgggtgctcacctggcggcgccagaggtcgctgggtcgctcgccggtggccccgcggctgtcgccgggctggtgtccggtggggccgggctcggtgggccggtcgtcgggtcggtggccggtgggccggtcgtcgggtcgctggccggggtggtgttcgctcatgtcgtgaacctagcgagacccaccgacactttcgggtggcttccggcgccggttccctcgaaggcgattgtcgtttcgctggctgggaccggaggcggtaggggagtcgggatgccggcgccggccgccgagcgccgtgcgggcgagccggggttgggtggtcgagccgggcccgcagggtgtgcgggtggccgggtcaggcgtgcagggcggcttcgaccagggcgagggctttgtcggcggggatgcccagggcgcgtgtggtttcggcgtacgccgctgctgctttctgggcccgcagcgatgtgccggtggcgcgggcggtgatgaccgtgccggctcggccgcgggtttcgacgaggccggcctgttcgagttccttgtaggcgcgggcgacggtgttggcggccaggccgaggtcggtggcgaggtgccggacggggggcaggcgggtgccggcggcgaggtggccgtcggcggcgagtgcggcgatgcgtaggcggacctgttcgtagggcggggtgggggagtcggggtcgatcgtgatgtccatgggttgtccggcctgttcgggcgacgaagggaacgaagcgggggtctcagatgagtgtggggggtgtgttgccggcggcgatgacggcccgccggatcgggacgagggcgagcaggatgccgccggtgacgaagaagacgacgagcgagacgatgccgaggcggtagctgctggtgagctggaagatgatgccgaagaacagcgggccgagccagctggtgcccttgtcgctgatttcgtagaagccgtagtactcgccttcccggccggtggggatgagttgggagaacaggctgcggctgagggcttggctgccgcccatgaccaggccgatgccggcgcccaggagcatgaaggggacgggggcgccggcggggagccagaaggcggccacgacgacgacgagccacagggcgagggcgaccaggatggtgttgcgggcgccgatgcggttggcgagggcgccgagcagcagggcgccgccgaaggcgaggaattggacgatcaggatggtgatgatcagcgtggattgttcgagtttgagttcctcggtgccgaattggctggcgagggagatgacggtctggatgccgtcgttgtagatcaggtaggcgccgaggaaggcgagggtgagcgggtaggcgcgcatcgacttgagggtgtggccgagctgccggaagccgtcggtgacgacgttgccgcgggtgggggtgctgtcggcgccggggtgttcgcggagccagagcaggggcagcagggtgaaggcggcccaccagacgccggccgagacgatggaccagcgggccaggtcgagggtgcgttgggggttgccgtcctggctgaacagggtgacggcgacgaggttgagcagcagcaggacgccgccgccgaggtagccgatgccccagccgcggctggagatccggtcgcgttcgtcggggccgccgaggtggggcaggaacgagttgtagacgacgacggaggcgccgaaggcgatgttggcgatcaggaacaggatgccgccgagcaggtagcggtcgccggtgaccagggccatcgcgacggtggcggcggcgccggtgaacgcggcggtggcgagcaggggtttcttgcgcggggagcggtcggcgacggcgcccatcaccggtaggacgaagacggtgagcagcaccgacagcgacaccaggtaggggaagtaggagccggcggcgacggtgagcccgaacgggtgcacggaggcgtggcactcgtcggcgtcgatggagcagccggcggcccgttcggtgaccttggtgaggaacgggccgaggaagacggtgatgaccgtggtggagaacgcggagttggcccagtcgtagaggtaccagccggtgcgttcccgtttaccggcgggtgcgggtgtcggggtgccggtgagggccatcgtgtgcgctccagggtgtgggtcggtgcgcgcacatgatgccatccacgggcgtttcaagcgagatgttggtcactgttcatcgggtgtccaccagcgggccagggcgctgatcgcggggtcgtcggaggcggtcagggcggtccacgggtcgctgccttcggggacgtcgaggccggcgtaggcggcgaggtcgtgcgggtcgaccgggtcggtggtgggggtgtaggcggcggcgtgtccgagggtggcggcgtcggtccaggggaagccgtcgacgggttcggggagttcgccgacttcgaggtggggcgggaagtcgtcggtcagcgccaccgggtcgtggtgggtgtccgggatttcggcgatgtcgtgctgggcgtcgtcgtggtgggcgtcgtcgtgtcccgggtcgtcatgatcgtgctgatcgtgcaggtcggacatgtccgtcaggtcgtggccggcgggcaggtcgtgggagtcgtcgaagtccggcaggtggtgatcgccgccgtcgtcgtggtggtcgaaaccgccccagtggtcgctcatctgtccctctcgtcgatcggtgccggggtcagcgcccgggcccgcagcagcgcctcgtccgcctggcgcacccgtacgcgtaccgtgtcaagctcttgctgggccaccgcgcgccgtttggcgcgcccggcggtgtcctccgcggcggccgcgtcgatgtcggcgatctgcgcgtcgaggtcgcgcagccgccgctgggtggcgtcgtccagggcgaccgacagggcgtactgcaggtcggtgaaccggacggtgatctcgtcggcgagggcggcgcgggcctcgccgagcacgtcgcgcagccagccgcgggcgtgctgccggtcggagtgcacgcgccggcggtacagcacgtacccgccggcggccaggcccagtccgattccggcgaccgggacgagcaggccgccggcggcgccgagcaccgagatgcccagggcggcgccgcgcccggccatgaacgcgatgccgccggcggacagggcgatcagcatgttgtcgccggcgccgtcgcgcggtggcgccgcggtcagttcgtggcgcagtgtcgcgttcagtttacccagcacggcgtcgcgttcgtccggttcgaaggcgctggtgagcacggtctcggcgacctgggcgaaggtgttctccaggcgttgcgacaggtcggcggcgaccgcccgcaggtgggtgtcgacgtcgtcgggcaggtgggtgagctgctcgccgcgcatcttgtcgatccgggcggacaggtcctgctggatgtcggcgacccggctgcgcagcccgccgaccgcttcgacccgggcgcgctgcacctcggcgttgagcagcagcgaccactggcgggactcggtgcgtttgcgggcggccagggcggcccggtcggcgcgcagttcggcctggcgggccgggtcggcggtggcggcttggacccgggtttcggcctgggtctgcaggcggccgagttcgccgcgggcggcgcgcagcacgttggccagttgcagctggtggccgcggccggcgagttcgatcagggcgtgctgcagggcggggatctgtgacgcttcggccagggtgctctggtggtcgccggcggcggtcagggcgagttcggcgaggcgggcggagaccgggtaccagggtgcggcggcgaagcgcggggcgtgggcctgcagcagggcccggttgtcctcggcgatgcgccgccactgcccgaacgcgtcgatcttggtgagggcgaagacgacggcgtcgacgcgttcggcggcctgggccaggaaggcgagttcggggctggacaggggggcggaggcgtcggcgacgaacagcagggcggtgccgcggcggaccgcgtcgagggcgacgacggcgtgcaccgggtcgaggccgccggcgcccggggtgtcgagcaggctcaggtactgcagcagcggggcggggtgggtgacctcgatgcggcgggcgcggtgggcgccgcgggcccaggcgccgaggtcgtcgaccgggacgctgtcgccgccctcgggcagccaggcgcgggccgagtacgccgggccgggcacgaagtcgaggtaggcggcggtggtgacggcggcgtcgaccggggacaggccggggaccccgagcagggcgttgaccagggagctcttgccgcgtttggtttcgccgacgacgaccacgccgggtcgggtgagctgggtgcggcgcagctcggcgaggtcggcggcggcgtccatgtcgacgccgcgcaggtaggcgaggctgtcgcggacggcggcgtccagggtggcggtcaggtcacgcatggcggacctcctgggccagcagctggaagccgcggtgcgcgatgtgcgcgacgcgggcctgggcggggccggcgccgtcgacggcgtaggcgcgccagcggccggccgcggcgatggcggcggtggccagttcctgctcgggtgcctgcggcaggtcgaggatgtaccgggggtcggtggaggtggcgaggcggatcagttcggtctcccggtcggcgggcaggcgtacggcgccggtcgcggcgcgctgggcggcgtcgagcagtcgcagccggtggtaggcggggtcgcgcagcacggtttccagggcgtcgcggacgccggcgcgcaggcgggggtcgccggtgtgcccggcgaggcggtccagccgggtcagcgcccagccggccttgatcgcgtcggcgcgccagccgaacgactgttgcagggtggtgcgcagccgggggatgccggaggcggcttcgaggcggcgcaccaggtcgccggtgcccagccggggttcggcggcgagctgcgcgcaggcgaagccgatgccgtacaggtccaggcgcccgaggagccgttcgcggtggtcggccgggatcggggcgggcagggtgcgcagcaggtcggtggaggtgagcagcagggtgagctcgccggtgggcagggcggccaggcgggccagggcgtcgcggtcggcgtcggtgagccggccggcgccggtggtctcggcgagcaggccgatcagcgggacgacgccgctgaccgtgcggcgcagcagggcggcctgctgctcggccaggggcgcggcgaccggccacgggtcgccggcgccgccggccagggtgtcgaccttggccaggacgccgagggcgttgatcgggctggccgccagacgggcggacgcgtcgtggaaggcgtccagggcgcgtacgtcgtcggcgcgcaccgcctgggtgaagacgtagatgacggcttcggcggcggcgacctcgccggccgagtcggcgtcgatgtcgtcgtcgaagggtgcgtcgccgacgacgtggcgggcgcggtcgctggaggcggtgtcggtcgaggacaggcccggggtgtccacgacggtgatcgttttcagtcggtcgttggtgagggtgacgtcgaggtaggcgatccgggtggcgggcacgccgaggcgggcggggaccatgccgtcgtcgtcgaggggcaggctgtggtggatgccgtcgcgggtgacgatgttcacccggtcggccgggccgtaccggaaccgggtgacgacccgggtgcactcgccggcggcggtcggggcgacccgccggccgatcagggcgttcactagtgtcgactttccggctttcaggcgcccggcgatcgcgacgcgtaacggctcgtggagacggttgccgatctgtcgtacctggccaccagcagcggaaccgaattccgtgacaatatcgtgacagagggtagccagtcgggtgctgagcgggccggtcaccgtgactcgtcagctgagcacaccgtcagcgacaatgtgcagaaggcggcagtcgacgtcacgaaacggggccctttctcgaccgtggatcaggatcaggtttgattacctgtccgcggcacagcctacggatgccgacaccacccgggggatcccgtgttcgtgccagagaaggaggaccactagtggcggacgaggctcacctggccgcatcctccactctgcgtcacggccccggcctcgtcgtgctcgccggcccgcccggctgcggccgcagcaccctgctgcagcgcctcgccgcgaccctcggcggcccggtgcacgccggcggcggcctggccatgctcgccggcgtcccggctagctagctagccggtcccgcccggcgcaccctgaccgcctgggcggtcggcaccggcttcccggccgccgccgacagctggcaacccgtcgccctgcgcgaacagatccgctgcctgctcgccgccggcctcaccgacccggaccgggaccgggccgtcaccgccctgctgcgcgccgaggagctcgccgacgccgccgggctgaccgtgctggccggccgcgcccgccgcggcctgcgccagcacggcatccaccgcgacacccgcagccgccgctccgagggcggcctcacccaacgcgaacaggacgtgctgcgcctggtcgcggccggcgagccgacccggcgcatcgccgggcaactcggcatctccaccgagaccgtcgacacccacatccgggccagcatgcgcaaactcggcgcccggacccgcaccgaagccgccgccctggccttcgccgccgccgggccccgcgcagacaccagcgacaacagcgaggatggccggtgaacaatccacccgacacaccacgccacgtagttgccggcaccgccgacgccgagaccatcctgcggcgcctggtccgcgacggctggaccgcccggcccggcttcgccctgcccgacgccaactgggatgtcaccgccgcccacctcgtcctgcacggccgggtctccgacgacgacacccacaccgccggcctggccgtcctggccgccgcccgcggcgccgccgtcatcgtcatctgcgacaccgactccccggccggccgcgccctgatcgacgacctgtcccgcatcggcgccgtcaaccaggaccccgacggcgccgacccggtcgcccacctcatccccgaacaacgcgccctgctcgaccgcctcgccgccggcgacaccatcgccgccgcggccgccgccgagtttctgtccctgcgcaccgccaaccgacgcatcgccgaagcccgcgccctgttcggcgtccgcaccacccgcgaagccgtcctggcctacctgcgccagcgtcaacccgactgaccttcgccccacccgctggacccgtccccgcaccctcgccgatcatgaacggatgaggcgctacacgctggccggattcgtggccggccacccgtggacgaccggcggtcaaccctggaccgccgacctgccgggcacggtggccaccgtcagcgactgcctcaccgcattcctgcctctgggccgggacatcgagccgtggcagcagcccctgttcgagccgtggcaccgtaccctgcgtcaggcagcccgcgcggccgagcgggcacccgggtcgcacgtgctgagcatgagcgtgccggccgacgggtccgacccactcaccaccatgatcgaagagtggatcggtgaccttccgcacccgatccggatcaacctcgcgcaccccgcggccgccccacccggaacgatccgcggacacgaggtcctcggcttctccggcggccgcttccacagctggctctgctaccgcctggacattccggcagccgccgaactcggcgtgcaggcggccggcaacgccctgctgagcaccctcgacgacgcccggcgagtcgccgacatggccaacgacaaccgcggcacccctgacggcaccccgcacgacatcacctggtttcccgcgctcatcaccgaacaccacgacgcggccccggcaccgcaacgctgaaccgggacagggcgctcgacgccggccgccggcaccgtcacgccgtcctatggcaagggagccggatgaccggcgatggggcgtggaacgcgctcatgccgatgcgtccgatcatgcccgtggtgacggcctatcctgggccggtgctggaaaccgtggcccgtgccctgttcgagtgtctgatgttcgttgaactcagcgacgacgacgccgttgaccccgacagcgcggtggccttgatggaatcggtctctcacgtgctgctcgagctgccgctcgccgagcgactcgtcctggtccagctggcgcagcgccaggccgagcaggagtcactaccggctcgccgagattttctggcgtcgctcggtggcggcctcggacttatcgacgaaggctgaccgaccgcggctgtgggcgccgccggcacctgcatgcgcgagggtgatccctcggtcacggccacccggacacgtgacgccggcccggtcaaagcgaggggtgttcgcctaatccggttcgtcgccgcatggcgctgagcatggaccggacgtcgtcgcgggccagccccgccgggtcagtggcctgagcgagcgtgcttgcggggcgtcggatcgtcgctcgccaccggtggtgggcgtgacggatcgaaatcgcggttgcagcggccgcgaagtcgtaccggatctccaggaccccctgcgtgccggccgcccaccaggcctgccagggtggtgtgcagagttgctcgagcagggcgtgaagagtggtctcgtaaccggcagggatgccgttcatcggtccgccaccgatgacctcgacgcgggcgccgaggtcatcgggagtcagcacggtgatcgcgggacgagtgacagatccgtcggtggtgccggctgccgactcatccggctcggcggtgcccgacgagcccggattcgtcagatcgagccggagtacgccctgctcctcgccgagcaggccgatccagggcttgatctccatggtgttcgcatccgtccagcgcagcgtccgggcggcgcgccggaaacctgccgaggtgctgaacgccagagcggacgcggacgcggcgaccacctgcccatcgacacgtcgccgggcctcgatgatcacccggccatagccgtcatcatgcagcacgaataccggacgagcggtatgccgccggtccgggctggtctttgccggcccggtccaccggaaacgcagaccggccgccagcgcgtggtcatacgcgcgagccagagcgtcgcagttcccgccacggtcgtgcgccagtcgagtggcggcggcatgcaccacgtccaagaccagacgcgcacggtcggtggccggcagtgccgcaacggtgggcggtatcgcggccgccgccgtctcgaacccctcgcgaacctccggatacaccgtcaccacgacatccgcacggctccggtcgagccggcagaagagccgcagctccgaatgacgtgcaggaatggccgcctgcgccaccgcttcgctgtacaactcacagacactacgtgcgctgcgcacgaacgcgtcctcgtcggggtgctccagccagggccgatcagggaacccggcaggcggccagaacccgaccatacgcaggtacgacatgctatcgatcatgccgcacggcagggagagccaccggcggtcgcctgcgccatgggacggactcgacgaaggctggcgccgcaactcgcgaacgggaccggcgcatggtctccgcgggtttgcaccgttgactacgatccgggacatggcgttccgggtgaagcgggtgcacgacgatgccgatccggccgacggctgtcgcgccgaactcgacgcccacccgcaggccgtggccgacccgcgccggacgccccgcgagcacggcacgatcaccctgctgcacagcgtccgcgagaccaccgacaaccatgcccgcgtgctcgccgaccatctgtccgccggcgccgacctgccggcaccggcatgacgctcggccgcgggaagctcgccgccaccgccgccgcgatcgccgccatcggcgtcggcatcggcatcggcatccacgggctcgggggccgcaccatcaccagcagcagccccagccccagcagccccagcgccagcccgagccccagcgccacctccagccccatcaccacagccaccaccagcagcaccagccccggcaccacgaccgccgacaccccggccggggcgccaccgccgggcaacgcgagtttcgactaccagatcggcggtgcctacaccccacctaccggggtcaccgtggtcagccgcgacagccaggcgtccccggcgcccgggctctacaacatctgctacgtcaatgccttccaggcccagccgggcacccagccgtggtggcaggcccaccaccccgagctgctgctgcgcaccgccgacggcgacccggtcatcgacaaggactggaacgaggccctgctcgacttctccaccgacgccaagcgcagcgcgctgaccgcgatcgccggcgcctggatcgaccggtgtgccgccgcgggtttccaggccgtcgagccggacaacctggactcgtacacccgctccgcagggcttttgaccaagaatcaggccatggtgtacgccacggcgctggccggccgcgcccacgaggagaaactggcgatcgggcagaagaacaccgccgagctgagcagtgccgacgcgcaccgcatcggcttcgatttcgccgtcaccgagcagtgcgccgacttcgacgaatgtgacgcgtacaccgcctcgtacggcgatcgggtcttcgtcatcgaatattccacggccggtttcaccaaagcctgccacgcctacggcgcccgcctgtccatcgtgctgcgcgacctggaagtgagcacccccgattccccgtcgtaccgttaccgggcatgctgaacgcggatcccaagcgacctgtaggggagaaacgttgagttcagtggtcaatcacatcaccgtcgactgcgtcggcgacccgtacgacctggcgcggttctggagcgcggtcaccggcaacccgttgtccgacgacgatcagccgggcgatccggaggccatggtgatcccgccggccggtaccggtccgttgatgctgttcgtccgggtgcccgagaccaagacggtgaagaaccggctgcacctggatgtcaaaccgaccgaccggacccgcgacgaggaggtcacccgcctgctcgggctcggtgcccgtccggtgaccgatcaccgccgcggcgacggctccggctgggtcacgctcgccgaccccgagggcaacgagttctgcgtcgagcgttccgacgccgagcgccgcgggggctgacccgggggttacgcaccttgaagtgcgtacttcctgatggagagttaccacgccatggtggaggaacacatccgctgggtggcacgtgccgcccagcccgccaaggatcagaggtaacagcatgtcgtctccttcgcttcccggtggctccgggaatctgggtggctcgccggtcacccggttcgggtacggcgccatgcagctggccggtccgtgggtgatggggccgccggccgaccgcgacggagcgctggccgtgctgcgggaggccgtcgagctcgggatcacccacatcgacaccagcggggcgtacgggccgcggatcaccaacgagctgatccgtgcggcgctgcacccgtacccggcgtcgttgttcatcgcgaccaaggtgggcgcccaccgtgacgcgcagggcggctggccgacggcccggcgcccgcaggatctgcgtcagcaggtctccgacgatctgcggactctcggggtggacacgctcgacctggtgaacatgcggatgggtgacgcccgggggccgcggcccggctcgctggccgaggcgttcgggacgctcgtcgagctgcagaagcaggggctgatccgccatctgggggtcagcaacgtcaccgccgagcaggtcggcgaggcgcagtcgatcgcgccgatcgtgagcgtgcagaacatgtacaacctggcgcaccggcacgatgacgccctcgtcgaccggctcgcggcggacgggatcgcctatgtgccgttcttcccgctgggcggtttcaccccgttgcagtccgcggcgttgacgtcggtggcggaccggcgcgggagcacgccgatggcggtcgcgctggcctggctgctgcagcggtcgccgaacatcctgctgatcccgggcacctcgaaggtggcgcacctgcgggagaacgtcgccggggccggtctggtcctgtccggcgaggatgtcgccgagctggacggcatcggccgctagcgcaagcgggcggcgtagccgggccgaggaggcggggaggaggatgcttcgggggatcgagggtgaggagcatccggtggcaacgacgacagccgcgcaggcacgggccgacgccagagggcggtacaacgcgtttctggcggtgtgtcccagccacaagatgctggagcggatctccgggaagtgggtcatcctcatcctgtcggcgctgggcagcgggcccggctgtgacggcgacccccgcccgatgcgctactcggagctgtcccgggtgctggccggggtcagccagaagatgctgacccagaccctgcgctccctggaaggcgacgggctgatcagccggaccgtggtgccgagcgtgccggtcacggtctcctacgagctgaccgagctgggcctgtccctgcaccacctgatgcgcggcctgaagaggtgggccgaggatcacgtggaggcggtgtcggccagccgcaccccggagtgagactcgaccgtggtggcggcgcgcagtgccgccgccacccgccggttgccggtcatcgtcgccgtcaccagggtcatgctcagcagcaggccgccgcccacgtacagcggggtgcgcacgtcgaacgcggcggcgagccagccgccgaggaaggcgcccagcggtgccgcgcacatggccagcatccgggaggtggcggtgacccggcccagcagatgaccggggacgatcgactggcgcagcgacggcgcgaggaccatggtcgcgcccatgccggcgccacagacggccagggccagcccggcggcatacgggttcggggcggcggccaggcccaggacggcgaggccttcgatggcggcggtgcaggtcagcgcggtgccggtgcccagggtccggcgaagcggcgaggcgaggccggcgccgagcagcccgccggcggcctcggcggtcagcagcaggccgaaaccggcggtgcccaggccgaggcgatcgtgggcgaacagggccaggacggtttcggcggccacgaaggcgatgttgccgatcgcggggcgcagcgcgaggccgagcagcagccggtcgcggaacacgtacgacgccccggaccgggcctgccgcagcagcgactcccgggcctggcgggccggccggtgcagcgccggcagtgacctgaccagcagggcggagacggcgaacgacgccgcgtcggccagcagcgggaaggcccggccgaggctgagcagggcgctgccggcggggccaccggcgctgaccacctcgtccggcgcccacaggatgccccgctcgcgcagcagatccgcggtccgcgggtcgtcgagctggttgttggccggcccggccaccgcggcgcaccgcagccgcggcacggtcgccgcggtcagcaccccgcccagcgcggccggcaccaggatgtcggtctcggcgcgcaggcagtcgtccgggccggtccaggtcgcgccgtgccggtcggcgagcgcccgccggctgtcgtcgacgtcggccacggtcagcaccgcgccctcggcggccagcatgcgcagcaggtgcgcgccgacgtggcccagcccgaggatcgcgatccggcgcccggccagctccggcgtgccgaaccggtgggtgcccacggcccgcagggcggccacgacaccggccgcggtgtgcggcgaggaatccccgctgcccccctgcgaccgcggacggcagaacacgtgccgcgtccggtcgtggatgaccgtcatgtcgtcggggccggtgccgacatccggaccggtcgcgtaccgcccgcccagatcctcgatcaggtcaccgacgtcgtgcagcagatcccgccgcccggccgcgtccagccggtgtccgggcggcagcgtcaccaccgtcttgccacccccgagcgggagaccggcgtacgcacacttggcggtcatcgccgccgacaaccgcaacgcgtcggcgagccccgcgcgccaatccggatagtgcttgatccggcagccgccggcggaccggccgtgcgcggtggcatgcaccgcgatcgtcacggccagccccgagcgctccccacgccgcgtaacaacatattcgtggtccatggcaaaaaactaatgaggtgtacgtcgtgggcgatctgtttccgaacgatgttcgcgcgctgggcgataattccggccgtggacgaacttgattcggcgatcgtggcccatttgcagaccgacgcccggcagaccaaccgcgacctggcccgcgccgtcgggatcgccccgtcgacctgcctggagcgggtccggtcactgcgcgagcgcggggtgatcagcggcttccacgccgaagtggacctcggcgccctcaaccgcgcggtgcaggccctgctgcacgtgcaggtccgcccgctgaaccgtggtgtcatcgagagcttcaaggcgtacgcgatgggcctgcccgaagtgctgtcggtgtacgtgctggccggcggcgacgacttcctggtacacgtcgccgtgcccagcgtcgacgggctgcacgcgttcctgatggacaagctcagcggccgccgggagatcatcggtttccgcagctcgatcatctacgagcacacccggaaaccggtgatcgacccgctcgacctgtgagccgtcagtcggcgaccgggaccggggtccgcgagggcatcggcatcagcgccacacatccgatggtgatccacgatcgccgtgacgagcagcacgattccggtgggcaccccggcgaagaacgccggcagcgcggtcagcacggcgacccggccacccgccgggcactgcactggttggccctgggcgccggaccgggcacgctgaccgccgcggcggccgcggacgctgagccccggcgtgctcggcctgatcgcggccggctgcgcgctcggctacgccccgttcgcccggctgttccggcagatcatcgagatcctgctgttcggcgcccggcacgacccgatccgggccgccacccgcgccggcggccgcctcggcgacgacccggtcccggccctgcggtcgctgcgcgaatccctggccctgccgtacgcggcgctgctcgacgccgccggcgaggtggtggccgccagcggcaccaccagcgcgaccgtggtgcgccaccggctggccggcctcgggcacctcgacgtcggcctgcggaccggtcagtcccacctgctgcccggcgccgtgcaggtgctgaccgtgctcgcccccgccctggcccagctgctgcacgcccgccggctcggcgccgacctgcgcgcctcccgcgccgccatggtccaggccatcgaggaggagcgccgccggctgcgccgcgacctgcacgacgggctcggccccggctgaccggtctcgcctacgccgccgacgcgatcgtggaagccgccgcgcgcgtcgagcaaccgactgcctgtgctgcactgccctcggagcgggtcagcacccgtacgttccggtgcggttccgggtctgcacaatgtcgcgggccggcatccaggacctgtcggtcaggtgtcgaccgtcaggtcctgggtgccgatgacggagagcagggccagcttctggtggctgtcactgcccgggacggcggtgtagaccagcagcgagtggccctgctcggggtcgagcagcgcctggcaggtcagttccagcccgccgacctcgggatgcacgaagcgtttgacgtgctggtaccgaatgccgatctcgtgctcgttccagacctcccggaattccgcgcacccgtcgagcaactgctgctgcagttgcgcggcgcgggagccggggccgcgcagggttgccacctgccgcaggccggaggcgaagacccgggagtgcagccggtggtcgtccgggtgataccgggcccggctggccgggtcggtgaaccagcgccagccgatgctgcgggccgggccggtgaaccgggtgaggtcgccgttgagggcgacgcccagcgcgttctggcgcagggtttcgccgagctcggtgatgatctcggccggggtgtcggtgagccggtcgaagatgcgcagcaggccggggctgatgtggtcgccggcgtcgccgcgcaccggtgggtggtgcccggccaggcggaacaggtggtcgcgttcgtcgagggacaggtgcaggccctgcgcgatcgacgcgaccatctgcggcgaggggtgcggtccgcggccgcgttccaggcggctgtaatagtcggcggacaggtggcagagcgtggcgacctcttcgcggcgcagccccgccgtgcggcggcgggtcccgcggggcaggccgacgtcctcaggttgcagggactcccggcgtcgccgcagaaactcggcgagcccggcccggtcgatcagcatgcgtccccctccatcaccacaaccacgcttccctcgccaggacgcgcccaccggtcaaccaggacgcgaacacgatcaggacgaccggtcgctcaccggtgcaacccggcggcgaacgacacccgcgtcatctcctcggagacgcgccagatccgctcggcgtcggcctccccgcgcagccgcgagtacagcttctgctcggccggcgccccacccaggcgcccgggcccgcccgggccgtagaaggcgccgtcgcgcccggtcgcggcgagcagcgcgggcaggctcgccgagtcggcggtgccgagcaggatgccgcgcgccgacagggcgccgatcagtcgccggccgatggtctgccggtcgcggccgacctccgggcgggcggccagcagactggtcggtgcgaccccggggtgtgccagggtgcaggtgatgccccagcccagccgccggctgcggcggctcagctccagcccgaacaacccgagagcgatcttcgattggctgtacgcccgcatgccgtcgtacgagcgttccccgttcagatcgtcccagtcgatggcgtgggagtcggccgcgacgctgatctggttgaccacccgcgccgcgcccgcccgcaggagcggcaacaggtgcgcgaccagggcgaagtggcccaggtggttggtggcgaactgcagctcgaagccgtcgatggtgctctgccggctcggcggggtcatcacccccgcattgttgatcagcaggtggatcggccggtcctcggtccgcagcgtggcgcccagcgccgccaccgaggccagcgacgacaggtcgagctcgcgcagagagacccgtgcggcgggctgctgccggcggatcgccgcgatcgcggcctcgcccttgtcccggttgcggaccgggaggacgacctcggcgccggcggcggcgagccgggtggccacgcgcaggccgatgccgtcgctgccgccggtgaccacggcccgccggtcggacaggtcgggaagggtgaggtcgggctgggtgcgcggcatgggctgctcctccgtggtcggtgcgcgggtgctgtgaccaggatgcggcggccggccggcgttaaccacggcctgtcgatcccaggctcgcggaactcacgaccggccggcgcggccgcgccatgccttggaggtggcggcggcggccggtgccgatatgacatcgtggtcgccgtgccggcgcccgcggaccggctcgacctggcccggcatccgagctcggacgccgacgacgctgtccgaggtaggacggggtacttcgatacagtcgtggcgtgcagccgagaatcgacgccggcaataccgtcctacggccgttggtgttgactggaggaccggcggtcggcaagacgactacgggtcggcttctggcggaaggccgagctcaggccgctttcgttgatgtcgatgatgtgcggcagctggtggtggccggggctgaggcgccctggcggggcacccagggagccactcaagccgctcttgcggccgagaacgcctgcggtcttgctcagcggtttctggctgaggggttcgacgtcgtgatcgttgacgtgcttacgccggctacgtcggtgatttaccggcggctgcttccgacctgcctgatagttcatcttcgggcaagtccggatgaagcgcggcgcagggcgatgactcggaaggtctggttgacggatgcggagtttgagctgctccaccgcagagatcgagaggcgcctccgcaagccgacgctcggatcgaggtcgcgggtctgacggttgagcagcaggtaaccgccgtcgcggacctctggttcggcgagcgctgacagggtcgccgacctgcccgccagcctcgccgagcagcagtggcgggcgccgaccgtgtgcgcgggctggcgggtgcacgagatggccgcacacctgctccagccggttcctgcgtgactacctcgccggccgggacgccgcgccgaccctggtcaggaccgtcggccggcgccttcagcccggacggcggggcgggcgggcggtcaagcagtactcccggccggccgggtcccgcagcgtcgtccagtccccgggcacccggcgcaccaccgtggcacccagcgactcgtgccgcgccacctcgcccggcacatccgtgcacgcccagtccaggtgcattccggccggccccgcgcccacccgctgcagcagcagcttcatcgggagcgtcggcggcggggtcagatgctcgaactccggcgccccggacggggtccgcgcccagccggtcagggccgtccagaacgcggcctccacctcgtacagctgatcgggaatgtcgagacacacctggtcgacgaccgcggaccggtccagcgcgacgatcttctccccggaccacgggaccacacagaacacgatcccggccggggaccgcagcaccatcacgtcgtcctgccggtcgacgacccgcgccccgggcacctcgaagccggcgaagtcgtcgacgtgcaggtccagatgcgtacgggccgggccgtccccgacgacctgcacccgcagccacgggtcaccggccggcggcagcaacgtcgcgaacgtgccaccgccgcgccgcggcgacatcaccgaaccggtcacggcgagccagaaccgctcaccggccgcggccagcccggcgggggagtccaggaaaccggtcacccagcggatcgtcacggcagcagcaccaccttcccgcagttcgcccgcgcctcgacgatctcgtgcgcccgcgccgcctgcgccagcggcaacgccgcgtgcacacacaccgtcagcccgagatcccacagctcacgaccgtgcccggcatacacctcaggattgccgcgggcgaagttggccatcgtgaacccggtcatcgtcttggcccccgccagcagatcgaaagcgggcaccgtgccaccaccactggcgaagaagatcagcctgccgccggcccgcaccgacccgagcgccgcgcccagcaggtcaccaccggccccgtcgagcaccacatccaccgggtccggcaacggcaaccggtcgtacgtgaccacggcatccgccccgagcccgtacaggaaatcggcttttccgggccccgccgccgcgaccacccgccccgccccgcgccgccgagcggcctgcaccagcagatgaccgaccccgctggccgccgccgtgaccagcaccgactcacccccgcgcagcgccgcgacggtcagcaccccgagcgccacatgcccggagcgcaccaacgccaccgcgtcgacgaacgaaccgggaatccgctccgcaaacgccgccggcaccgccaccacctcggcatacgaaccaccgaacggcaacgccgccacccggtccccgaccgcccaacccgacacgcccggaccgataccgatcacctcaccggcgacctccccacccggcatcgccggcagcggaccgtccccgccgcgcacccgcgccaccccgggccgggtcaccccgatcgccgccgcccggatgagcagctcaccctcgcccgcaaccggctccggaccgtcctccaccaccagcacctcgggaccgccgtgccggtgataacgcacccgccgcatcagtgtcagttcctccccgtccgcaacgcccgcgccacatccgggcgcccgaaaccctcggcgaacccggcggcgacctcccacggatactccaccgcccgcaactgcgcctcccaccggcccgacgcatcgtcgaccaccgcataccgggcatgcgggctgccggccgccatctggtgctcgaacggccggtcatcggtgtacgccggccagccgacactgccggggttcacgatcagcggcccgcccggcagccgcagcgatccggccagatgggtgtgcccgcacagcagcagcgccggcccggcggccgccgcaccgagccgctcacgcacctcgtccccggtcgcgtcccgaaccccgtccgcggtgaccgtgtgcagcagatactgcaggtcgtcggtgggcgtgccgtgaaacgccagcacccccggtgcgggcgacaccaccgccggcagcgccgccagccacgcccgatgcgcaccggtcagcaacccggtggtgatccggtccgccatgccctggcgatcctcgggcagagtcagcacctgccgctcgtggttgccggccaccgtcaccagatccgcggcgatcaaccggtccgcggtctcggccggctgcacatagcccgacagcagatcacccaggttgacggtcagatcgacgccgtccgcggcgatcgccgcgagcaccgcgtccaacgccggcagattgccgtgcacatcggagatcaccgcaagccgcatgcgatcaccctacggcgacgggaaacccattttgatacgccaaccgggcgtccgcccccgccgccagcacatccagctgatcatccaaggtcagaaacaccgaccacggctcacgcccggacaccgccaccagccgctccaccaccagctgctccagatccggcacccgcttcgccttccacaccttgtcggcgacggcgaccagcagatcctccacgcccagccccggcgcatcccacaccccgtgactggccgcgaaccgggccagccgcggcgccacccccgccgccaggagcagccgctgcccggccgactcatgccgcgaccccggacccgacaactcccgcggatgccacaccttgccgatgtcgtgcgtggccgccccgaacagcaccgccgcccgatcgaagaccagccccggatacgccgcggcgagccagccggtcaactcccacgccacatcgtgcaccgcccgcagatgcgcgcccagccgcggtggtgcctgcatcgacaccagaagatcagccacctccggcggcaacaaccgcagccgcggtacgcacggatcccgcaacgccccgctcaacgtggccgcagccatcaggcacccccctcggcgagccgggtgaaccggcgggcgaactcgcggtaggcgaccgcgtacccgtcgtcgcgcccgctcaactgtcgcacctcggcccggaccagacccaccgcacgctcgcgctgcccgccggccagcgccaccgccggcaccaccagatgccgcgtctgctgcgccaccaccgtgccgatgtcacggcgcaacgccaccggatccgaccagcggtcgatgaacggctgcccgcgcaccaccacctcctccgccagctccgcggcgatctcgctcagatccgcccccgccgggaaccgccagccccgccccagcggcaacgtcacacacgccaccggctcatcccagccggccgtcgccaccaggatccgctccaccaccgcatgccgcaccccgaccaccggctccgccaccaccgacgtctgatgatcggtcaggcccaggtccagccagccggaatcggcctgcaacaggatcccgtgccgccgccgggtgaaaccgcaacaggccagcgctcgcgcgcaggcgtccgtgacccgtttccgcaccgcacattcatagcatccacaaaggacgggtgagcgcatttcgcgatacctgtcgttaccgacagttccaccgccgtcgattcaatggagtatcgaccccgctcccgccggcccggtcggcttacccgctcagccacagcgaccggaccggacccgccgtcacccacaccgctcgacgaccaccaccacacccaccgcggcgagctgttgccgcaacagctccatctccgcctcggtcccggtcacccccctctgccgtacgccgtccaacgacccgatcgccaccccgcgccgccgcaacacccgcagcaccgccagccgatccgcctccggaaacccgacccggaaccgtccaccctgcgccagcaccgcctgccgcagctcgtcaggcaacccgtcccggccgcacgagacctgatccccgtccggacaccggtgatggacgtcccacagcagccgcccatcccggacagcctccgacaccgtcgccgtcccgcagtgaaacggcacccgcacctcacccaccgcagcatcatggcagccaccaccacagcgaccgggactgtgccaggagcggtgtctccggcccgacatgccgggctgaggcccggcgggatgggcactgtgagtagcgacattgaacgttgcgagtccactcgctgagctgccccgccggtagatcatccggcggtctcacgagggtgataccgaggagcgggcgctcagcgggccaggacgatgagggcagcggcgacgtaccaggcgttcgtgaccagaaggaacagccgctcggtgaccccgaagagccggcgtagtggccggaacatggtgacggcgacggcggcgagcagtacgggcgtcgcgatggcgagccaatgtggcacgtcggggtgtgaggtggcggcgcgcagcgtgggggtgaggccgtcgatggcgaggtaggtgagggtgaacgcggcgatggccgacaggtagtgggcgatgccggtcggtgtgagcccgcggccttcgaggtcggtcgggaagacggcgatgccgatcctggctaccggcagcagcaccaggtagaccaggggagtcgtgggcgggtccaggttcggtgcgagggccagggcggccgcgagcgcgaggacgcccagcgagttgacgatcaggccggtgtggaacaggcgggcgtaccggcccacgccgtagtcgctgacggcgtggtcggccagccggtatccggtcggcaggacgtgcagcgcggtgatgatgatcaggtaggcggcgagcgcgatgagagccgcggtggcagcggtctgcgaattgatcatgatgatggggaagatatcaagcgctcgcattccgatcttcgcccgcagccgtccaccgccggaccaccctcagcgaccccgcccaggacgacaccatccgcgtcggcacccaccagcggacccaccatcaggagcaccaccgagccggaaacggcgcaccgtatcctcggcgtacgcgacgaccagatcaccgcccgggcccccggccagccgatcgcgacaggaccgtacaaaagcaatcccggtttaaagttcccgagtccaaacccggaatcagaccaacaaagcctcaaccacaggagaatccatgagcgactacgacgaacgctaccgcagcggcaacacaccctgggagatcgggaaaccacaacccgccctcaccgcactgctcgaacacggcgtccgcggacccaaagtcctcgacctcggctgcggcaccggcgacctcgcctgcaccctcgcccgccgcggataccacgtcaccggcatcgacatctcgcccaccgccatcgaacgcgcccgccagaaagccgccggactcaccgccaccttccacgtgcaggacgccaccaaactcgacctgcccaacaaaccgttcgacaccatcttcgactccggcctgctgcacaacctgcaccgcaacggcggacccgtcgaccagtacctcgcccaactccccgaactcgccgaacccggcaccctgctctacatcctcgccatctccgccaccgccggacagggatggaccatcacccgcgaatacctccaggaaaacctccccgaacccacctggaccgacaccagaatcaaagacgtcaccgtcaccgcccaggtcgacgacaccaccatcaccatgcccgcctacctactgcgcaccgcccgctcctactgacccacatcccccggaatcacactgaacaccgccagatcagcccgccccgaccgcgtccacgacgcattccgcaacaccccctcgaaccggaaacccgccccccgcgccacccgccgcgaacccacattccgcacatccgtctgcaacgtcacccgcgcgaaccccaacaccgacaacgcccaccccgccaccaaccgcgccgcctccaccgcgaaaccattaccgcgcgcccacaccgccgtccagtaatgaatctccaccgtcatcgccgaccagtccgccccgaacaaccccacatgacacgccaaccgcccactggaccgctccaccccggcgaacacctcaccccgggcacaccagtccgccacccgggacagatccgcacccgcgaaccggaaaccgaccggcgcgaaccgcagaaactcccgctcgttccacaccgcatgcacccccggcgcatccccggactcgaacggccgcaacaccaggcgcgccgactccaacctcacccgcggaatccccgactcaacgcccacggtaaaaagaaaccgcctccgccaacgccagatccgtcagcaccggatcatgccgggcacccacatcccgcatgaacgcatgctccccaccctgataaacatgcaactccgcatcatcgagccccgccgcatacaacgcacccacgatccgcagccgcgcctgcgaaggaacatgcggatcccgcgacccgaacaccaccatcaaccgcccccggatctccccggcccgcgccagcgaatccgccacatccgcacccaacccaccatcctgcaaaccggtcggataaaaacacaccgtcgccgacacccgcggatccaacgccgcccggaacgccagatgcccaccgatacagaagcccgtcaccaacagcgccgacacatccgcccgggcctgcagataatccagcaccgccacccgatcggcatcgaactgcgccgtcggcgtcgccgccgcacccgccaacccccgcgccttgcccgcatcgtcgaacgccaacgccaccccggccagctcaccccgcggatagatctccggaacacacaccacaaaaccctccgacgccagcctgcgcgccgaccgcaacgtcgactccgtcagctgaaaaatgtcggtgtacaacaacaccccgggaaacgacccaccaccggacggccccaccaccaccgcacgaatctcaccgattcgcacctcatcctcgaccagcttcatgcgagccaacctacgcccggcacgatcacgccaactcgcgcaacacccggttcgtacgattcgactggatcgccgcccgctgctgctccgccgtcacctcgatatagttctgcgacgtcgccaacgacgcatgccccaacagccgcatgatctccgacgcattcgccccatcctcggcaagacgcgtcgcaaaggtatgccgcaatgcatgcaactgcgcaccccgcggcacccggtcaccgatacccgcccgccggaaacacgaccgcaccagatactgcagaccaccccgctgcaacggcgccccatgccgatccaccagcaaccgatccacactcgccacccgaccgaaccgcacccgccggctcgccacataccgcgccaccgcggcatccagccccgcatcgatcggcaccgaccgcggccgcccacccttaccggccacctcgatccgccgctcaccatcacgacccgacaccgcaccgacggtcaaccccagcaactccgaaagccgcaacccggcacacagagccaacgccagaaccagcacatcccgctccggccacggatcacgctgacgctcatccgcgacactcgccacccgcaacaattgctccggcgtgtcctcaccccgcaacggcttgggggagtgcgccaccatccgcggcttgtccaccgccgacatcggattgcccgccaccacaccctcggtcaccagaaacgtgaaaaacgcattccacgacgaccaggcacgcgccacggaagcgggggcgcggtccgccgcgaaacgcgcgaacgccgcccgcaacaggcgaggggagaggtccgccggatcggccggcgcgggggacacctgccgcaacaccagggacagatcgcgccgatacgcagcgagagtgtgcgccgacggcttccgcgtggcccgcgcggcgaggaactcctcgaccaggtcagaaaggggagagggcggatcgacagatggttcgtgctgcataagagatattatgcatgatatatccgcattcgtgcccgtctgcaccgtagcatgcccgccaccgaccaggacacccgatcacccgaatccgccggtcggggagggcagccacgatgccgaacacccccgcatgcgtggcgtggctaaaccggtgtggaaatcatctcgggaacggttccgcccagcacggtagtcacccggaaacgctcggaccggtcggtggtcaccgttggccggctaccacgggcggatcgggccgcggctgacttggttcggctcgccgatccacacgacgcccggcaactggcccgactcggccatctcgatctgccggaaaccattgagttcggcgtgatgcgctcgccggaacgggccggccccgcggtgaaacctccacagcttccgggccggtctgccgatcgcacgagacgtcccggagtgacaccgcaggggatggcacgaccacacctctccagcctctagttgacataatatacattatcgacctgagattttggcgagcggaccataggctgacgcgcatgccgatccccgcattcgtcctcgccctgcgcgccaagctcgggcacgacccactgcccttgaacggtgtgatcgccgtggtgctcgacgagaacaaccggatcctgctcgtccggcgctccgacaccggcgaatgggccctcaccaccggatgcctcgaacccggcgaacaacccgccgacggcgcgctccgcgaggtcttcgaggaaaccggtgtccgcgcacgggtggaacgcctgctttccgtggaggcgctggatctgtcggtcgcacccaacggcgatcagatctactggctcgccatcggtttgctgtgccggtccgtcgagggtgacgcccgggtcaacgacgatgaatccgtcgaggtgggctggttcgatccggattcggtgccgccgttgccggcgcaccaggcgcgatgtctggcgctcgcgttgtctgacgacgccggtccctggtttgccgctcccctggattgacggcgtcacagggacggctgagcggattcagcggcggcggcgatgggcgcggcgggaaatgccgggttgcggtggctgcgtgcggcgcggttggtttgcggggcgaagtagacagcggttgtacggtgtttcggccggctccgaacgcaggctcgtgccctcgttcgcacgcggcgatgtggtctcggtgcggggctcgcggggcggcatccgaggtgtgctcccgggtcaaggcggtttgccctctccccggctcaaggtgatcccgcaacttgcggttgcgaaaaggtcgagccggtcagtcccggtgacgggccgtcggctgaatgggttcgggcgggtttcgcgcgaggacggttgtctctcccccgggcctccatgatgatcaacatcggtggtcggtcggcgggatgggtgtcgtggtggatgcggggcgcgcggggcgggccgacgtgcgggatgcgctggcgggtgcgggtttcgtggtggagggtttcctcgaccacgcggagctgcccgcgcagggtgaggtgtggcggccgttcatcatgtcgtcggcgcggccggtgaaatgggtacgtcatgagtctgacgatcatgatgcccgggtggatcggctgtggcatctggtgagtcgccgcaacggcacgatcgatgcggacggtgcggtgctgctgtcgttggctcagggttcgttcggtccgttgccgtggattcgggtgcgggtcggtgagtcgttgccgcgggtcgcggggttccgggagttcgtggcgttgtcaccgacgacgtgggcgagtagcgcggtcagcgaggaggagtatgcgacgtggattctcgctgatccgctcccctgagccgcccacccgcgtgtgcggctgatcggccgtcggcccggtctcgtccgcgcgcgctgcttcctgagcccgtcgattttgtcctcgtcccggctggatccgttctttgcggctgtcagtcatgagggcgaccggttgcccgggatgagacggtccgccgagccggtcgacccggttgcgtccggctgagtcgttgtcgggtccggcgcggcgggcgtcggcggttcccttgagcgctgccgccctctggggcgccggccggtgggtcgcggtcttgcgggtgatcttgtcgccggccactccctcaataatgatcatcttcgccggagcgctgggcctggtcgatgaagtgcccgatcaggctctcccccgggctcgcatgatgatcaacgtcgggggtcggtcggcgggatgggtgtcgtggtggatgcggggcgcggtgggtgtccgtgctctgtgggctgctctgtgggccgtgccggggtggtacaccggtgcgtgcccggtgatgtggcggccggtcggatcggcggcggtggtgcggtggtgcgtcacgtgcggtggggtggtcggcggggcgtggggttcttgtcggtgggggctggtagaaagaaggccctctcatacaggcgtacgaaggtggggctgagattgatggcggcggcgggtgtggaggcccgtgggttgaccacggaggagttggacgggatccgggacgcgttggcggccgggcgcaagcctcgggtgcagttcaccgaggcggcggggcagatcgccgggcagatcgggcaggtggtggggctggcggatccggcggtctccgatgagtgggtggtggtccggttcggtcgtgatgagctgcccttctcccccggtgatctgcggatcgcgccgaaaggggcgccggtgaggaaggtggtgccggtggtggagccggagcctgagccggtgttgtcggggccggagtttctgatcgacaagccgatcgggagaccggtggagaagccgcgggcggctccggtgcagcggcgtggggatgacgatggtgtggtgggaaaggatgtgcaggacgtgacggctccggctccgcgtaaggtggcggctcgttcggtgaaggcgaagccttcgccgtcgttgacggtgacgctggcctacggcgagggtgagtggacggtcggggcgacgcaaggtgccaaggcgctggcgaagccctatgtgatccgtccggccgaggcgttgaagatggtgcagctgatcgacgttccgggggtgcaggaggcggtggagcagatcctgtcggcggagcgggcggaggcggagcagcaggcgcagcggttgcgggcggagttggcggagatcgaggcgcggttggcggagctgggtgaggcgggtcagcagccgtcgtgatcaccggtggtccggtggtgcgtcgatcagggagcacgggccgggtgtcggtgtgcgtccgtgcccggccgtctcgtgggcggcttggtgacggggtgctgctcccccggcgccgctagcggcgggtttcccgatggccggaaacggcgaagcgctcgcacggggcgagcgcttcggcgggatgggggcgtgacgactggccggggccggttcggcgcggccggtgggggctgtttactgggcgctgatggtgccggtgcccagcagcagcaggagcagggcgccgagggcgaggcggtagaagatgaagatgcggtaggagtgcttggcgacgaatttgagcagccaggtcacggcgaagtaggcgacgatgaagctcacggcggtggcgacgatggtgttggtccagccgacgccgtgggagatgttgtcgtattcctcgtagccctgcagcagtgaggcgccggtgagggcgggcacggacaggaagaacgagagtttggtgacggtgacccggtcgaggtcgcgcagcaggccggcggacatggtggagccggagcgggagatgccggggatgacggccaggcactggacggtgccgatgatgagggcgtctttccaggtgacgtcgtcttcgtggcggacctgggtggcggcgtagtcggcgaaggccatgacggctgaccagacgatcagggcgatggcgacgaaccagaggctgcgcagggtggtttcgatggcgtctttgaaggtgagtccggcgatcacgatggggatcgagccgaggatgacggccagggcgaatcggtagtcggggtgtttgcgggcgtcggcgttggtgaggcctttgaagaaggccgggacgatccgcaggatgtccttcatcaggaagatgatggtggccaggacggcgccggactggatgatcacggtgaaggcggtgatgtccgggtcgtcgaggcggtagccgagcagtttttccaggatggtcaggtgtccggtgctggagaccgggaggaattcggtgacgccttccaccgcgcccatcagaatcgcctgaaagatgttcaacctgttcccgccctgtttgttccgttgcctggccggtcagagcatagggggcgggcgacgcgctcggtgtgtggggctaggcggtgcggcggcggtcgcgggcggcggcgatggtgtaggcggggtcgcggtcgaggttgtggcggtcgcggtcgtagcggcgggtggtgcgtgggtcggcgtggcccatggcgtcctggacgtcttcgaggggtacgccttcggcgcgggcggtggtggcgaaggcgtggcgtagcgagtgtggggagagtttgtcggcgccggcgatgccggcttcggcggccaggcgccggacgaggcggaagacggcgtgccggtcgaggcgggcgccggtggtggtggcgaacagggggccgggctgggtgccgcggacgcggaggtaggtgtcgagggcggcggcggcgctgggggtcaggacgcggcggcgggggcggccgcctttgccggtgaagcggacggtgcggtggccgcgctcccagccgaggtcggtgaggtcgaggctgacgagttcgccgacgcgcaggccgaggtcggcgagcagggtgagcacggcgcggtggcgcacggcggcgggtccgtcctggcggtcggcggcggccagcaggttgtcgacttcgtcgggggtcaggccgatggtggcggagtggtcgcggtcgacgtaggggcggtcggcgtcggcgacggggttgccggtgacgacgcggagtttgacgaggaaggcgtaccagctggagagcccggagagtttgcgggcgacggtggcggcggccatggggcgggcttccaggccgcgggcgtaggcgttgacgtcgaggaaggtggcctgcagggggtcgaggtggtgttcggtgcaccaggtgagccaggtggtgacgtcgcggcggtaggcgtcgcgggtgtggtcggacagtcgccggttttccagccaggcgtcggtgaagcgggtggctgacgcggtgacgtggggcagcagcgacatggggtccatggtgtcagttctcgatcacggtgcggtcggcgacatgccagtggcgggtgtgtccgacggcgtcggcgaagtagtggtcgtgggtgacggtgagcagggtgccgcggtagcggcgcagggcttcctcgatgacgtcgagggcgtcgaagtcgaggaagttggtgggttcgtcgaggagcaggatgcgggcgggactgttgacgaggatggcgagcagcaggcggcgtagttcgccggcggacaggtcgcgcagccgggcggtccactggtcggggtcgaactggtggccggtgagcaggcgttcggcgtcgtcggcgtagaccgggacgtgggcgcggaagtggtccaggacggtggtgtcggtgcgcaggtggtcggtggtctgcgggaggacggcgacgtcggggtggccggcggcgatggcgcgcagcagggtggttttgccggtgccgttgcggccggtgatcaggatccggtcgccacgggtgacgtcgaggtcgatgtggtcgagcagggtgcgctcgccgaagccgagggtgaggtcgcggattgccaggacggtgtcggcggggtcgccgtcgtcgtcggggaaggcgagggtcaggggtgggcggcggcggggttcggcgatccatcgtacggaggccatctggcggcggagccggcgttctctgactttggctttgcgggcgacgcggcgggcgacgcggcgcaggtggggggcttcggcgccggagcggacggtgttctcgacgccgcgggcgtggttcttggtgcgttcgatgtcggtttcccagcgcaggcggtccttctcctgggcttcgtagtcgagcagcaggcgttcccagcgacgttgtttttcctggcggtaggcggtgtagccgccgccgggatagtcctgggggtgttcgtcgatgccgtcgagttcgatgatgcgggtgacggtggcgtcgaggaaggcgcggtcgtggctgacggtgagcacgccgccggggaattgctggagccagtcgcgcagccaggtggcgccgtcggtgtcgaggtggttggtgggttcgtcgaggagcagcaggtgggggtgggagagcagggcgcgggcgagcatgaggcgggcctgttcgccgccggagacggtggccaggggcagggtgtcgtcgaggtggtcgatgtcgaggcgctggcggatttcggtgaggcgggtttcggcggtccagccttgcagggcggtccagcgttcctgggcccgggcgtaggcgtcgaggacgtcggcgccggcggcgagccggttctccagggtgcgcatggtggtggtgacggtggcgagttcgccgaggccggcggtgaggtaggcgccgacggtgtggtcggggtcggggatctgctgggtgacgtgggcgatgcgggttccgggggtgcgggtgacggtgccgtgggtgggtggcaggtcgccggcgagcacgcgcagcagggtggttttgccggcgccgttggggccgacgaggccgtagcggtcgccgtcctgcaggatcaggtcgacgccggagaacagcaggtcgccgtcgtgggtgcgggccagcccggtggctttgaggtgggcgggcatggcggcctcctgggggtgggctcgggtgggaaccaatccggggaccaatagtggacggccggatgggcctgaccggcgttaggctgcgggcgtcggcctcgaccaggcccgtgtgcgccacgcgcgttgatggcacgaccgtccgtgatccgtgggttatgttctcccgctggaaggaccctgtcatgcgtgtttccgctgttgccagctcccccgtgcgtgatctgttggcgctcgtcgaccggccggaggtgatctcgttcgccggtgggctgccggcgccggagatgttcgatgtgccggggtggcgggcggcgttcgacgcggcgttgagcgggccggccgcgcgccggcatctgcagtatgcgccgaccgagggtgatccgcggttgcgggagttggtcgcggcccggatggccgggcgcgggttggcgaccggggccggtgacctgttggtgacgaccgggtcgcagcaggggttgacgctggtggcggcggcgttgctggagccggggtcgacggtggtggtgcaggagccgacgtatctggcggcgttgcagtgtttcgcgatggccggggcgcgggtcgtgtcggtgccctccgatgagcagggggtggatccggcggctctggcggaggttctcgtgcgggagcggccggcgctggtgtatctggtgccgacgttcgcgaatccgaccggggcgacgatgagtgcggcgcggcgggcgcaggtggccgcggtggcggccgggcacgaggtgtggatcgtggaggacgacccgtacggcgagttgcggtatcgcgggacgccgctggcgccgctcacgacgtacggtgatcggggtatttatctgggtagtttgtcgaagatcggtgcgccggggctgcggctgggttgggtgcgcaccccggcggcgctgcggtcggcgctggtgatcgcgaagcaggcggccgatctgcacacgtccacgatcgatcaggccgcggcggcggcctatctggcggccaccgaccttgacgatcatgtgcgccggctgtgcgacgggtatcggttgcggcgcgacaccatgctcgccggactgcaggggatcaccccgggtggtacgtcgtggaccgatccggacggcggcatgttcgtctgggtgcggctgccggagggcaccgacacgaccgcgctgctgcccgtcgcgttgcggcacgacgtggcgttcgtacccggcgcgccgttctacgccggccggccggacccggccacgctgcggctgtcgttcaccaccggcacgccggagcagatcaccgagggtctgggtcggctggggcgtgcgatcgacgccgcatttgacatgctggcggggtccgacacgtgacctgaggagacaccgcgatggcgaagctggtctcgacactgttcatttcggccgatggggtggccgagattgatcccgcatggcatttcccgtacttcgacgacaacatgggccgcgcggtcagcgaggactacgagaccgcggacgtgctgctgctgggccgatcgacgtacgacagtttcgccggggcgtggccgctgcgcgaggccggcggcgaggacgacgcgccgttcgccaagcagctcggcgacacccgcaaggtggtggtgtcccggcagtcgctggagttcacctggcgcaactcggagctgctcggcggggagctggccgcgggtgtggcggcgctcaaggccgacccgcaggtcaagggcatcctggtgcccgggtcgatctcggtggtgcagcagctgctggccgccgggctggtcgacgagctgcgcctgctggtgcatccggtcgccgcgcggcgggggcggcggctgttcgacgagggggacacggcgtaccacctgaaggtggtgagcaccgaggcgttcccgaccggggtgctacgggtgatctatgcgccgggtgaggcgccgttcgtggccggctacgaggagaccaagggcaaggtctgactccggtggggccgccgcggcggccccaccggctgcaaccgggtcatgccgccacggccaggcgcatgccctgcgcgtcggtggcactcagccgcgtcgccatggtcgagcgggcggcgatctgcgcggcgtacgcggcgcggcgccgggcgacacacccgtccttggcgaccgggccggacacctgctccatgtgcgtggtcagaccgtcgcgcagcagggcgagagcctcggtgcgcagctgcgacacccgcgactcggtcaccccgagctcggcggcgacctcggacagcggacgctcctgcaggaacgaggcctcgaccacgaaccgcagccgctccgggagcaccgtcaccgcgtcgtgcaggtagcccaggcgctcccggtgcagcagcatctcctccgggttcatcgccgactcggtcaccatgtcctcggcggtgcccgaggtgaacccctgcaacgacagcaccgcggcacgctgcacgtcgtcgtcgacgctgctgagctcgccgaccgcgacaccgagcagttcggccagttcctcggcggtcggggtgcggcccagctggcgggtcagctcctcgcgggccacatcggcgcggcgggcccgggcgcgcaccgaccggctcgcccagtccatgctgcgcagctcgtcgagcagtgcgccgcggacccggacggcggcgaaacggccgaacgggatgccgcgtgccgggtcgtaggcctgcgcggcggtgaccagcgcggcgtagccggccgaggccaggtcgtcgcggtgcacgtgcggcggaaccttgaacagcatctcgcggaccatgtgaccgacaagcgccatgttgtcgcggatcatctgctcctgctcccggctgacggagcgggtgttgccggtgtgctgcgcggtcgcggtcatgtcgaatccccccgtggtgtcggttgcagggggaacttttcgcggcgacgggtgcagcggatgggcactcttggttgccgctcggttgcactgcgaatttcttctcaagtccgggaggcgggttcatagcagacccacagcgcggccgtcttgactttgccggcggccgtctcggctttgccggcaggaacgccgccgggcctgggcggccggcggcgtctgtatctacccgctgttgccacccggctttcgccgggggtgcggtgtggcttacgcctggtcggctcagcccagcagccagccgttgtcgacggcgaggcggaccgcctcggcgcgggtgcgggcgccggtcttgccgatcgccgaggacaggtggttgcgcaccgtgccgtcggacaggcgcagctcccgggcgatgtcggcgaccgtgccgccgtcccgggcggcctgcaacacctgcgactcccgttcggtcagcggcgaatcgccgtgggccaggctctgtgcggccagcgccggatccaccacccgcaggccctggtgcacccggcggaccgcgtcggccagctgccgggccggggtgtccttgacgacgaacccgtgcgcgccggccgccatcgcctgacgcagatagccggcccggccgaaggtggtcaccatcagcacccggcactgcggcagcgcctcgttgaggctgcgcgcggcgctgatcccgtccaggccgggcatctgcacgtcgagcagggcgacgtcgacctcgtgggcgcgggccgcgtcgacgacctcgtcaccccggcccacctcggcgaccaccttgatgtccggttccaggtcgagcagggccgccatcgcgccgcggaccagagcctggtcgtcggccagcaacagtttgatcatgaggggacctccactcgaacacggaaccccggccggtccccccgctggccggcggtgaggtgcgcgcccagttcctcggcccgccggcgcagcccggcaagcccctgacctggattgtcattgccgacggcgccctgaccgtcgtcgactatctcgacactgttggggctcaggcgcacctcggcgtgccgggcccggctgtgccggacgatgttggtgaccgcctcccggatggtccaggcgaacagctcccggttacgggtcggcacgtcgtcggcggcaccgggcagatccgcctggacgttcgccgcggtcagcgcggccttggcggcggcgatctcgccgggcagcgagatgccgcgcatgcccagtgcggtcgcccgcacgtcggccagcgcgtcgcgggccagtgactccagatcggccagctcggcgcgggcccggtccaggtcgacgtcgagcagccgctgggcgagctccgccttgaccgcgaccacggtcagcgaatgcccgagaatgtcgtgcaggtcgatggcgatccgggcccgctcgtcggagacggccagctcggccagctcgtgctgggcctggatcagccggccctgccgttcgaaggccagccgcatgccccaggtcgcggcgccggccaggatcaccgccagggcgtagccgtgggcgctggtggtctgccacccgggcacgaaccgcacggtcaactcgatggccgcggcgatgaccaccacgaccgtcaggccgtgccgcaggggcaggcccatcaccgcggtcgccgcgatgtacaccccgcaggtcagcgtcgtctcaccgaccgccggcacctgcaacaccgtgaacaccagcatgaccagcagcgcgatccagatctgcagggccgaggccgtttccgggccgtcgcggcggtgccggcgcatggtggtcgaggcgaccaggaaggtcgccgcgaacagcaacagcgacaccaggccggtgtcgcgccacatgccgtccggctggtggagcaggatgttcaggttctcaccgagatagaacagccagatcccggcgaacacccagccggcccggaagcctgggctgggtgttcgcgtcgtggccgctgccccggacggtgccggtgtcgcggtcggtgccggtgccatgtgatgacggtaccggcaggtcagacgcgggcggtgtcgcgacggaaccgccacatcgcgccggcggcgaagaccaacgtccaggcgaccacgttcagcacggcctgccacagctgaccgtcgtgggtgtccgggtagcgggccagctcaccgacgccgtacaccggggtccacttggcgatcgcggcgaacgtcgagccgaactggtcgagcggcacgaacaggccaccggcgaacgacaggagtgccagcaccgggccgaggatctgcatcacgttctcgctgggcagcaggtagcccatgaacaggccgaacgcggcgaacaccagggcacacacccaggccagcgcggcgcaggccagccactgggcgaccggcaggtccgcgccgaagaacagcccggtgacgttgacgaccactaccgacaccaggccgatcagcatcgccagggtcagcttgatcgcgacgtacgccgccggcttgagcggggtcaggcgcagctgacggctccacccggcggcccgctcgatggacaccatcgccccgcccgaggtggtcgccagcatcgcaccgtagacggccatgctgatcagcacgtacgcggtgacgttgccgtcgccgatgcgctcgtgcttgtagtcggcgctggtgccgaagagcaggaagaacgccggcggcatcacgacactgaagatgacggtgcgcttgttgcggatcaggcgccgcaactccagggcgatcatgcccaggttgaagccgccgaatttgggaagtttgcggtccgtccggctacggtccacggtcacggcggtcatgccggcttctcctcgtcatcgtcggcggtcagggtcaggaacgcgtcttccaggttccgggaggtgatctccaggtcccgggcctcggtctgggtcagcagataccgggcgatcgcgtcggtgtcgcgcccgtgcaggtagatcgtgtcgccgcggatctcggtcgtctcgaccccgggcacctgcgacaggtcggcgcgttccgcgtcgggcagggtggcgcgcaccgtccggcccgcggccagcgccttgacctcggcggcggtgccgtcggcgacgatccggccgcggcgcaccagaaccacccggtcggcgtacgcgtcggcctcctccaggtagtgggtcgcgaagatgaccgtgcggccaccctcggcgtcctggcggatcgcgtcccagaactcgcggcggccaccgacgtccatgccggtggtcggctcgtcgaggatcagcagctccggatcgggcagcagggccatcgcgaaccgcagccgctgctgctggccgccggagcacttgccgaccagccggtcggcgatgtcggcgatcccggcccgtttcagggccacctgcaccgacgagcgcggcttgccgaacagcaccgcggtcagccgcacggtctcctcgaccgtgtagtccttgagcagaccaccggtctgcatgaccgcggacaccagcccgagcgcgaccgcctcgtgcggggcccgcccgtacacctggacggtgcccgcgctgggctgcgagagcccgagcagcatgtccaccgtggtcgtcttgccggcaccgttcgggccgagcaaggccaccacctctccggggcggatgcgcaggtcgattccgttcacggcggtgaccgtgccgaaacgtttgaccacgccgtccagattcacggccagctgccccgtaccggaggccgcgagatcggttgaagcggtgagcgtcatgggaacattgtgttggcgcaccatcgtgctgtcccccgctatgcgtcacggctcgcccatgacatccgtcagtatgtgctttgtccggcggcgtccatcgacgacactttccgggatggaaccgacgcacagcgcccttatcgttcctgtacccgaagccgagccggcggtggccgacctgagggcccgactcgaccgggccgcgtcctggggagtgcccgcacacatcaccgtcctctacccgttcctgccaccggcccagctgaccccgcaggtgctggccgcgatccggctgatcgccgccggcgtgccgcgcttctatctgaccctggacaggatcggctggttcgacgaccgggtgctgtggctgtcacccagcccggccgaacccttccgcgaactgaccaaccggctcgccgtccgattcccccagacccagccctacgagggtgaattcgccgacgtcatcccacacctgaccgtcgggcacgacacaccgggcctgcccgaagcagccgcccaggtgcagccgctactgccgatccgggccagggtcacctcgctacggctgatcgccggccgccgggagcccggcgactcctggcacaccctgaccgactttcccctcggctgaccctcccccgacccggctcgcccacctgacctacctcaggtgacggcccagtccgctgtccctcaggtgaccgcccacctgaccgtccccggatgatgacccacctggcgatgctggcccgggctaagcgtcggccggctcgctcgccacgacctgctcgacggcggccttggacaggcccagattgcgcagcgtgccgtcctcctgctcctcctccagcagggccagcagaacatggccggtgccgatgtcctcgtgcgacagccgcaacgcctcccggaaggtcaactccagcgccttgcgcgcccgggcgtcgtagggcaccagctccgggacctcaccggccggggccggcaggaccgcggtcagccgctgccggatctcgtcgatgcccaggccctgcgccatgatcgcggtcaccgcggtgccctgcggctggtcgagcaggccgagagccaggtgcgccgggctgatctccgggttgccgtgcgccttggccaggttcaacgaggcgacgatcgcggcgcgggctgcctcggagaaccggttgaagccctgcgaggggtccagcttctcccgggggacgaagcgtttctgcgcggcctgcttggacacccccatgctgcggccgatgtcggtccaggacgcgccggagcgccgggcctggtcgacgaagtgcccgatcaggtggtcggccagctcgccgaggtggtcgccgagcagcacggcatcggacaggcggtccagcgggtcgtcggggcggtttcggctgatggcggcgatcagatcatcgaggcgtaccggcggatcaatctgcgtcatgccgtcaaccttaggttgacgaattgctggcgtcaaccttgagttgacggcgtagggtgagggtatggatctgaccccgcggcgatggcgtccggccgacgccgacgagctcggcccgctgctcgacgacctggacgtccgccgaaaccatcgtcgcctcgacgggaccggctgggtgaccatgctcgacccggagggcaacgagttctgtgtggagcgcagcgcgcccgagcgggccggtcaggagccgcttcggctgcgcggggcccccgcttcgcggccctcccggacaaccgggggttccgggactccccggaggcgggcacgcatcccgcacgacggcccgctccgcgcgcccggcagccagggggaatcaggacttcgcggcctcgcggcggccgcgcttgcccagcggcacttcggacatgtcgaccgtctgcgaggtgatcttcttgtagccgtaaccgtgctcctccagccacgccaccgccttcatctcggcgttgatcgcggcctgcgggatctccttctcctcggtgacctgctcggcgaagcggaaggtgaagaacgggcgggccgcgatgtcgtacgtcaggtgaccctgctcggtgtactgcgcggtcagcaggtcgtcaccaccgttggcggtcagctcggtcttctgcttgtcggtcagattgtcgaaggatccgcggacggtgacacggatcgtgcgggtctggctcatccggccagtatcggcatgccggcccgtcagcgacagccgattatcggcagcaggtcgccgggggcggccagggtgtggtcggcgggggctgccgggtcgtgcatgtggccccaggccgcggcggcgctgcggctgcccgcggcggtggcggagcccaggtccaggggcgagtcccccaccatgatcagccggtcgggggtgaccccgaggcggtcggcggccagcagcatgccgtccggggccggtttcggggccctgatctggtcgccgccgatcagcaggtcgcaggtgatgccggcggcgtgcagcagcagcgtggcggcgcgggtggaggcgccggtgaagacgaccagcggcaggccggcggcatgcagagcgcagagggtgtcgaggatgccggggtagacgggcacgctgacgtcgtccagctggcggaaatagatctcctgttcagccggggacagggggcggccgaccaggtgggtgaggatgacctcgttcgtgccgcgccaataggagccgaccacgtcggcgggcgtgaccggtgggccgcccagcacggccaccgcctgcacgaaggcgcgcgggacggcctcggtggagtcgatcagtgtgccgtccatgtcccacaccggaatgatcatgcgggacctctctggggtgggcggtgtcaagtggggcttctcctgactggagtggatcatgcagtgaggaattcgtgggcgccgcgcaggcgggtgtgcagcagctgttcggcacggtcgacaacgaggcggacgtcgccggggcggtgcaggccccgtgcggtgagcgtggtggcggggatcgcggccggatcgaggccttcccggcgggcgaccaggacgcccaggtcgtaacgggagatcgggtcggcgccggcgacgttcaggattccggcgtagtcgccggcggccagttcgagcagggcgtcggccaggtcgtcgacgtggacgggggtgcggatctcgtcggtgaacagggcgccccgggcccggccggcgatcagggcgcgggtgaggatctcgtgggcgccgttgccgtcgcccaggatcagggaggtgcggacgacggccgcggagggggtgatggcgcggacggcggtctcggcggcggccttcgcggcgccgtagcggtagacgggatcggggagggctgactcgtcgtagtggatctcgcggccggagaagacggcgtcgctggagacgtgtaccaggcggatgcccgcggcggcgacggccaggtgggcggcgccgtcggcggtggacggccagtcgttgcggtcgcggcccgaggcggtgtgcacgatcgcgtcggggcgcaggtcggcgaggacccgacggatgccggccgggtcgcggatgtcgaggtggacagacgcggtcggggccggtgcggccacataggtgccgatcggctcccatccggcggccgcggcacgggcgaagacccggcggcccagggagccactgccgccggtgatcaacagtcgtcgtgtcacgccgggcagcttaaccgggctccgcgatcagtccggaagcagcgagacggcgcgggcgcgggattcgggggtggcggggagcagcggcaggcgtacggacggggtggggatccggccctgcgcgtgcaggacggctttgatgaccgaggggttgggctcggcgaacagggccgcggacagcggggcgagcaggtggcccagtttgcgggcggtgtccaagtcgccggtctgccaggccgcggccagggcggcgaaccggtcggtggccaggtgcgcggacgcggtgatgccaccggcggcgccgagggccagcatcggggacagcagggcgtcgtcgccggccaggatggcgaagccgggcggcgggtcggccagcaacgcgaccgcgtccgggtcgaggctgccggtggcgtacttgatcccgatcacgcggtcgagtgagccgatccgtcgcagggtgccggcgtccagcacctgaccggtgcgggccggcacgtgatagatgaccaacgggaccgggctggtttcgctgagcgcggtgaaatgggccacgacaccgtccgggccggggcgcacgaacggcgggacgacgctcaaccccgcgtcggccggcgcggacacggcgctaccgaccgatgcggacacagcgccgcggggcggtgcggacacgggcccgccggccagcagcgggacgtggtgggcggtggcgacccgggacagcacggcgagcaccgcctgctgctcgccgggggtgagtgacgacggctccccggtggtgccgagccccaccaggccggccgcgcccgcctccaggacctcgtgcgcgagccgttccagggcgggtaacgccaccgctccggacgcgtcgaaaggagtgatcatcgggacgaggacaccggtcagctgcatgcagtccagccttgccgccaacgagcatcacatccagttcacgtttgtggggccatccgtaagctcagctgatgctcgacgtacgcaagctgctgcttttttgtgatcttgaacgtctgggaacgatcgccgcggtcgccgcggcgcgggcctatacgccgtcggcggtgtcgcagcagctggccgcgctggaacgggaggccggggtgccgctgctggaacgcaccgggcggcgggtgacgttcaccgcggccgggcggatcctggcccggcacgccaccgccgtcctggcgacgctggaggaggcggacgcggcgctcgccgcggtgcggaccgggccggccgggccgatccggatcggcgccttccccagcgcgatgcgggcgctgctgccgcaggtgctggtcgcgctgggccgcgaccatccggccctcgaactgacggtgaccgaattggacccggtcgcggtgccggccgcgctcctcgaccgcagcctcgacgtcgggctgctcaacgactacgacatcgcgcccgccgggaccgacccggcgctggagtccgtgcccctgctgcaggagaccgtctacctggccgtaccggcgcccgccggcgccggcacgctggccgcggccgcggatctgccgtggatcctggccaccccgggcaccctgtgtcacgaggtcacgctgctgatctgccggaccgccgggttccgcccgcaggcccgccaccatgccgacgacttcgccacggtcctcgccctggtcgccgccgggcagggggtgtcgatcgtccccgaactcgcggttccggccgcgccggccggagtccggctgaccgccctggacacccggcggcgcacccggatcgcctaccgccgcggtgccgcgacccacccggccgtcgccgcggtgatcaccgccctggacaccgccacccgcaccgcgccgacgctcagcggcgcgccccgatgaggaagcgacgggaatgggcgacgagatcctcgaacgtacccatgggtgaagatcatgcaggatgggtcgcatgactgtcgccgatgtctaccgggagttcgcggccaccgaggcgcgcggggtgtcgccgatctacgaacgcctggcccggcaggtggccgccgacccggagctgctcgaccggctggccatgctgcccgcaccgaagcgtcagccgaacctgctgttcgcggtggtccggctgctcggcgggccggtgggtgacccggccggcttccacgacttcgcgctcgcgcagtgggacgcgatcctggctcagctgatggtccggggcacccagaccaacgagatcgggcgtaccgccgcgcttcttccggttcttgcggcgttgccgcaaccgctcgcgttgatcgatgtcggtgcgtccgcgggcctgtgtctgtatccggaccggtattcctaccgctacggatcgcacgtggtcggcgacagcggcccgctgctcgactgcgcggccaccgggttcaccccgccggaccggctgccgcgggtggtgtggcgcgccggcctcgacctcaaccccctcgacgtgaccgatcccgacgatgtcgcctggctcgacgcgctgatctggccggagcacacccaccggcgcgatcggctgcgccaggcggtcgccatcgcccgggccgacccgccacacctggtccgcggcgatgcggtgaccgacctgccggctctggccgcccaggctccggcgggtgcgacgctggtcgtctaccacacctcgatgctgtaccagttgcccgaccggcaggcgttcctcgacgtggtgcgggccctgccggcccgctgggtcgccgtcgacggcgacatcggcgccgacctgcccgagccgcccaccgccgatctgtacaacgtgctcgccctcgacggcgagcccctggcctgggtgcgcgggcacgggcagagcgtcacctggttcggcgcacattcactcacgtaaacgttttaaacaccccacgcgtcgaggttcttcgataggttgcagcggactgcttcacccgatcggaaggagctcgacgtgcgacgactgctcgtggccacccttgccacagcgttgacgctggccgcaacgggcgcggccgcccaggcacaccccagggtcgccgcgcccgcacccggcgcgcccggcatcggggacccgtactacccggactacggcaacggcgggtacgacgtctcccactacgacatccggctgcgctacaccccggccaccgacaagctgaccgggaccaccacgatcctggccaccgccacccaggatctgagccggctcaacctcgacttcgtcctggacgtgtcgaccgtcctggtcaacaaccggccggccaccttcgcccgcgagggcgaccacgaactggtcgtcacccccgcccggaccgtcgccaaggggggcgcgctgaccatcgtcgtcacgtactccggcgtgccgtccaccaaggtcgccggcggattcaccgcgtggacccgcaccccggacggcgccctggccgtcggcgaaccggaaatcgcctggtggtggtacccgagcaacgaccacccggcggacaaggccaccttcgacgtgtcggtctcggtgcccgacggcgtcgaagcgatcagcaacggcgtccagccgcgcccgccggtccgggaaaccctcggatacacccggtggagctggcgttcgctgaagccgcaggccacctatctgaccttcctgaccatcggccagtacgacgtcaccaccgacaccaccgcggacgggtcggtcgtctacaacgcctactcccagctgctgagcccggacttccgggacgccgcccaggccagcgtcgaacgcaccgcggagatcaccgactgggagtcgacggtcttcggcccgttcccgttcgaggcccgcggcggcatcgtcgtcccgccgaacacgatcaatttcgcgctggagaaccagacccggcccaactactccgccggcttcttccggcgcggctcgaacacctacgtgatcgcgcacgagaacgcgcaccagtggttcggtgactccgtctcggtgcggacctggcagaacatctggctcaacgaaggtttcgccagttacgccgaatggctctggtcggagaagaacaacgagggaaccgcccaggagatcttcgattacctgtacgccacgtctcccgacgacgcgccggtgtggaccaccgcgccggccgatcccggcaccgccgagctgttcggcgacgccgtctacgaccgcggggcgatgaccctgcaccagctgcgcctggccgtcggcgacgacgcgttcttccagatcctgcgcacctggaccgccacccacaggtacggcaacggcacgaccccggaattcaccgccctggccgagaagatctccggaaaggacctggacgcactgttccaggcctggctctacaccccggccaagccggtggtggccaccgcggcacgctcgctgagcgcgccggtcgccccgaagtcgtgggcggcgatcaagcagacccacgcgctgctgcacgagcactgaccggtcgggggccgcggcgcgcgccgcggcccccgactacgggcggacggcggcgagctgggtggcctgggcgaccagggcgcccttgctgtcccagagcagcgcggtctcgtccatccggccgctggtgacctcggcggcccgcatggtcatgcgcagcgggccgggggcgggcagccgccgcaggtacgcggtgaggctgaccgtcggagcccaaccctggatgccgagggtgagcgagatcggcggggacggatcgagcgcgacgagcaggctccacgggtcccagtcggtgccgtcgctcagccgcagccagccgctgacctgcccggtcgacgacggctggcccacggcgaaacccagacacgacgggtcgaggcgatgatcgacgacgtcgagcaggtgcaccgggaacgcggcgcccggcgggcgcgacggcagcaggaaacagtcgtcctcggccggcaggtccgggaccggcaggcccgaccaccacggcgccgcatcgtcgagccggccctgggtgagcagcgactcggcgcacggctcgccgtcctggctgagccgggcccggtactgcgccgagccgcggccggagcgcagcagctcgacaccgaccgtcgcggcgccggccgcggcggccgcaggaacgcggtggtcatcgccaccggatgcgggtgcgccgcggtgtccgcggcggcggcgaccgcgcgggcgatcaccgccatcaggtagccgccgtggagtttgtcgccgacaccccactgcggatcgaggtcggcgtggtatccgtcgtcggccggctgcacggcggtggcctgcgggaagctctgcacccgaccaccctagaggcgttcgatgatcgtcgcgttggcggtgccgccggcctcgcacatggtctgcagcccgtaccggccaccggtgcgctccagcacaccgagcagggtggtggccagccgggcgccgctggcgcccagcgggtgaccgatcgcgagcgcgccgccgtcgacgttgaccttggccgggtcggcgccggtctcggcgagccaggccagcaccaccgaggagaacgcctcgttgacctcgaaggcgtcgatgtcggccagggtcagcccggcacgccgcagcaccgccgcggtggccgggatgatgccggtcagcatgtggatcgggtcgtcgccgacggccaccgcggtgtggatccgggcgcgcgggcgccagccgtgccgggcggcgtactcaccggtggtgatcagcagggcggcggcgccgtcgttgaccgggctggagttgccggcggtcaccttccagtcgatcaccccgaaccggcgctcccaccgcgggtcggcgaacgacggcgccagcgcgctcatcgcttcccggttcgcccccgggcgtaccgtctcgtcggtgtccaggccggccagcggggcgacctgcgccgcgaatcggccggccgaccaggcgcgcgccgcgttgtggtggctgagcagggcgaactcgtcgagctgggcgcgcgacaggccccatttgcgggcgatcagctcggccgcgacgccctgcgggatcaggccgccgtcgtagcgttcggtgatcagcggcccgccgacgtcgtggcccagggtctggctgccgatcggcacccgcgacatcgattccgatccggacgcgatgaccaggtcgtacgctccggagatcacgccctgggcggcgaagctgagcgcctgctggctgctgccgcactgccggtcgacggtcacgccgggcaccgattcggggagtccggcggccagcgcggcgagccgggtggtgttcccggactgctcccccacctggccgacggcgccgccgatcacgtcgtcgatcgtggccggatcgaggtcggggacgcgggcgatcagcgcgcgcagcacgtgggcgtgcagcgagacggggtggatcccggcgtacgcaccggtgggcttgcctttgccgagcggggtgcgcaccgcgtcgacgatgacggcgtctcgcatgggggtttctcctgaccacaagtttcggaccgatcggtcccagcgtagcggagagttggaccgagcggtccgttaccattgtcaccgtgccccgccccgccacccccggctcccgcgacgcgatcctgcacgccgccagccggctgttctactcgcacggcgtccgcgcggtcggcatggcccaggtgatcgacgccgccggctgcggcaagaacctgctgtaccggcacttccccagcaagaccgacctcgccgcggcctacctgaagctggtccgcgccgaccgtgaccggtccgccgacatcgccctgaacggcgccgccgacccgggcagccgactggtcgcgctggtcggcgaggtcgccgccctggtccgcggcccgcactaccgcggctgcgcgtttcgcaactacctcaccgagttccccggcgacgacgacgaaccggcccggatcgcccgcgcctacctgcgtgacacccgtgcccgcatcgacgacctggtcgccgcccggggcctggcaccggtcaccgccgaccggatctggctgatcgtcggcggcctgtacgccggccccgccgaccaggccgaggtcgccgtcgactgggtccgcgaactcgtcgcccaggtcggatatccgaccggcagcactggttcgccccgccacgggataaataacggctgatgtctcggtcgtggggttcctcgcccggcccgactctgggacgctgcacatagttccccgtcgttgtggactgctgggaggtcgtcgcccgtggaggttgccgcctggttgtggacggtcaccctggtcggactcggcgccctcgtgctcgccgacctcgccctggtcagccgccgcccgcacgagccgagcctgcgcgaatgcgccctgtgggtcaccggttacgtcaccgccgcactgctgttcgccggtttcctgtggctgcgcttcgacggcgccgccgccgggcagtacctggccggctggctcaccgagtacagcctgtcggtcgacaacctgttcgtcttcgtcatcatcatgtcgcggttccggatcgaacgacgccaccagcagaaggtcctgctgatcgggatcatcctgtcgctgctgctccgcggcgtcttcatcgccctcggcgccgccgcgatcagccgcttcaccggggtgttctacattttcggcggcttcctgatctacaccgcggtccggctgttcggctacgacaccgacgagccggaatacgccgagaacatcgtcatccgctgggcccgccacgtcctgccgatgaccggcagctacgacaacgcccgcctgaccacccgcgatgcccgcggccgccgccgcctcaccccgctgatcgtcgtgttcatcgcgatcggcaccaccgacgtgatcttcgctctggactcgctgccggccatcttcggcctcaccgaccagccctacctgatcttcaccgcgaccgttttcgccatgatgggcctgcgtcagctctacttcctgctcggcggcctcctggaccgcctggcctacctgtccatcggcctcagcgtcgtcctcggattcatcggcgtcaaactcgtgctgcaggccctggccgacaacaatctgcccttcgtcaacggcggcgacccggtcgactgggccccgcacatcagcatcggcgtctccctgtcggtcatcgccggcactttgtcgatcaccgccctggcctcgatcctcaaagcccgcctcgacgcgtcgaagatcagctcacgacgatgacgcattcccacggcgacggattcgcggggcgacggtccggacggcgatgtggacgggcggacaaataaagatcagtttcttcatgtcccatgctgcggccgatatctgatcgccgctcccgcggaggccgggcagggcgattttggccgctggcgcgtccaggacaaatcgccctgcccttcattgcccgtggccggtcaccgaaaagaccgcccgtggccgccggccgagccacggctttcccgcaccatcgacaccgaccgtgtgcgtccgccacgcgaagggcgctcgccatcactcccggaaaaagtgctcgccgcgccaccggcgaccaaccggacgtggctgatataaaaccaccggctcacccttttaccgatcggacatcttcaccatctctcgtgggcgcgacgattcagcgaaactcgccgcacctcccccggtactgcgacctgagcctgatcccgataagtcagaagtatcgccgggcgcccgcattccctgccgacaagtggcatgttcctgttgtgcccggatcgcgcggcccggccgaactacggaggagattcccatgaatattcgtaagccgttcctcggcgccgcactgaccaccgcagtcctggccgggacgcttggcgtgagccgggccgcacaggcccgggccgccgactggagcaccgtggccgcaccgtatttcgccctggtcttcgacgagtatggtggccccaccaccatcgggcacacccagaacgagtacgtctacgcggtctgccagcaggacggcatctggggctggcaaaccaacgcctacgtgccgtcgctgtccgcatacggctggatccgcaacggcgacctcttcggctataccaatccggctgagggtctcagcgtgtgctgacggatgagcatgccgaccatcgccggcgcaccatccccgcgctcccggtggatccgggtcggcgctaggctcgtccgtagcgtcgcgtgtcggtggcagaccgtgtcaggcatggaggcgccggacggaaggggagatcaccatgatgatcgttgtcccttcgccccgcccctgtgggtgagggcgagaagaccagggtgatcgcctggaatcgcgagctgcgcagcgtccacggcagattgcgcgaggcgctggcagtgacccggcacgcgttggccgcgggcgaagcggtcgagccggccaccagagatctgctgctgttctgtcacgggttctgcacggcgctggccgcccaccacgagggcgaggatcatcacctgttccccgcgatcgtcgagcagcatccccacctgcgggaaacgctgcgtcgcctgcagcaggaccactcgatgatcgctcacctggtgggtgggctgcagtccgccgtcgcccgggctgcgccacccgcagagctgcaccgtcacctggacggtgtggcggcgatcatggaatcgcacttcaggtacgaggagcgccagctgctgagcatcctggagggcctggctctcgacgtggaaccgcactcagcgctggggcccctgtaaccccacggctatgcgcccgcggtggatgcgctaccaggtgagctccgggccgtccagcgagaagtagcggggcgaggtctgatcgtgccggtccagcagtgccgcgaggcgttccgcggcgtcgaccggatcggtggcggcgtcccggccacccatcgccgtggtcagcgcgcccggatggaccgcccagcagcggatccgcccggcgaattcctgggcgagggcgaccgtcagcatgttctgggccgccttcgagatccggtaggcgtagctggtccggtgcgcggcgaacaccccggccgcctgcgcggtcagcgaacccaaccgcgacgacacgttgacgatcagcggatcacgggcctgcagcagccgcggcgccagcgcctgagccagacgcagcggaccggccacgttcacgtcgaccgcggccagaatcgtcgccgggtcggtctccgcgagcggccggcccggcgcaccgatccccgcgttgttgaccagcacgtcgacggcccgctccccgaccgcggcgagtagctcctccccgaccgggtcccgcacgtcgtgccgcacgacccgcacccggccacggcccgcagccgcaccggcatcccggacgcaggccaccacatcccagccgccggcggcgagccgctcggacagggccgcgccgaaaccgcgggccgccccggtcaccaccgccaggcggttcaccggctcaccgcgcactgccggaagcgacggtgcggaacagccggtcgcaccaccgagccagccacggccgttgaggagcatcggaacgagaactggcgctaagggtgatcttgatccgggcggacacgattggggtacgtcggtcgtcgtgatcggctgaccgttagcccggcttcgatcatgttcgatctcttctagcgttttgggctgtgccggttgagttcctcactgatgagcaggcctccgcctatggccggtttccggccaggctgacgccgacggagctggagggcctgttcttcctggacgacttcgaccgggacctggtggcccggcgccgcggtgacgagaaccggatcgggttcgggttgcaggtggcgaccgtgcgggcgctgggcttgtttttggccgatcccctcgaagtgccgaccgaggcggtcgactacgtcgcgcgccaggtcggcgtggcggatccgtccagggtcaaggggtacctgcggcgggagaagacgcgtttcgagcatcagtgggagatcgcccgggagtacgggtacaccgacttcgccgcggcggagccggagctgattcgctgggtcgatgaccaggcgtggacgagtggggacgggccgaaggcgctgttcgacgtggcggtgggctggctgcgcgagcgcaaggtgctactgccggcggtgagcacgctggcccggctggtggcgcaggttcgtgggaaggccactgatcggctgcacgagcggctgtcggggctggtgtcggcggagcaggcgcggctgctggagggtctgctcgacgttccggagggttctcggttctcgcagctggagcggttacggacgccggtgacgaggacgtcgggtatcggcatggtgcgggcgttgcagcgggccggtgaggtcgccgggctcggcttgggtgggctggatgtcgcgatggtgccgtggcggcgggtgtgggagctggcccgctacgggttggaggcgaaggcgccgacgctgcgccggcacccgtacccgcgcaagctggccaccttgctggcgacggtgcgggcgttggaggcgcgctcggtcgatgacgcgttggagttgttcgacgtgctgatgaccacggagttgatgagccgggccgagcggcagtcgaaaaaggagaagctgcgccgctatccgaaggtgtcgcggcatgccgggaagctcgcggccgcggtggcggtgctgctggaggcggccgagtggggtgagcaggtgcgcctgcagcaggtgtgggacgcgatcgagagcaaggtgtcgcgcgctgagctgcgggcggcggtcgccgggatcgctgaggtgttgccgccggcggacgcggatccggatggggagtggcgggcgcatttgctggagcggatggccaccatccgcgggttcgtgcccatgttgtgtcaggtcatcgagttcggcgccaccgcggacgccgcgccggtgctgtacgcggtcaacggcctgccggagctgctggatgcacggcagggccgcaaggtcgccgccgggttcctcgacgcccgccggatccaggtggacgtcgtgccgtccggctggtggcagcgcctggtgttcccgaaggaccggccgccgggcacggtggacaaggccgcgtacgtgttctgcgtgctcgagcagttccatcagcggctcaagcgccgtgacatcttcgccgcggtctccgaacgctggggtgacccgcgggcccggctactcgacggcgacgcctggcagcaggccaaggcgcccgcgttgaacgcgctgcaactgcccgaggaaccccacgacctgctgcaggctcacgcggtgacgctggacgaggcgtggcggacggtcgcggccgggctgtccgcggacaccgcggcccggctcgacgacgagggccggctgcacgcgcagaaggtcaccgcgatcccggacccggcgagcctggtcgacctgcgccatcgggtgcaggcgatgctgccgcgcatcgacctgggcgagctgatcttggaggtgatggcctggtacccgggcttcgcggccgcgttcaccgcgctgtccgggtcggccacccgcctggacgacctgcacgtgacgatcgccgcgaccttgacggcgcacgcgctcaacgtcgggttcgcccggtcatctccgacggcatcccggcgctgaccaggggccggatcagccacgtcgacgcgacctacctgcggccggagacctacgccgccgcgaacggcgtgttgatcgacgcccaggacggcatcggcatggcccgggcgtggggcggcggcttggtcgccgcagctgacgggatgcggttcgtggttccggtgcgcagcgtgcacgcccggccgaacccgaaatacttcggtcagcggcgcggcgcgacctggctcaacatggtcaacgaccaggccgtcggcaccgccggccgggtgttgtccggtacgccgcgcgactcgatgcacctgatcgacctgctgtaccggcgcgacggcggccgccgccccgaggtcatcatcaccgacaccggctcgtactccgacgtcgtcttcggcctgctgcagctactcggcttcgactaccggccgcagctggccgacctgcccgacgccaagctgtggcgcatcgaccgcagcgccgactacggccccttggacgcgaccgcccgcgggatcatcgacctggaccggatccgccggcactggcccgacatgctgcgcatcgccggatccattcacacctggcaggtgtcggcctacgacgtgctgcgggtgctgtcggccggcgggaacctgacccagctcggcgaggccctggcggcctatgggcggatttttaagaccctgcacgtgctgaccttcgtcgacgacgaaccgtaccggcgccagatcaagggcatgcgcaacctcaacgagggacgccatgacctggcccggcacgtcttccacggccgccgcggggaactgcaccgtgcctaccacgacggcatggaggaccagctcggcgcgctcggcctggtccttaactgcatcacgctgtggaacaccctctacctggacctcgccctggccgggctgcgtgcgcagggctatccggtcctggacgccgacgtcggccggctctcgccgttcgtgcgccaccacatccgcgtccacggccactacaccttcaccctgcccgacttgggtgggcgcacctaccgcaggctgcgcgacccggacgccggcgacgacgagtagatcggagaggagctcagcagggctagtgccctgttgaccggcttggctggcacaacggtggtggcgacgctggcggtgatgcggtcgcggcggtcgtgggagatgtcggtgtggtgctggccgccggggtggctgtcggggtcgacgtggacggtgacgccggtcagccggggcacgccgtgggtgagttggtgttcggcgtcggcggcgatttcgtgtgcggcgagcagggtgaggttggcgtcgacgacgacggcggcttcggcgtgcatgcggtgcccgatccagcgcagccgcagaccggagacgtcgtgaacgccggggatggcgcgcaaggtccgctcggcctggtcgaccagttcagggtcgacgcggtccatgagccggtggtagacctcgcgggcggcgtctttgaggacgaaggcgatcgcgatggtgatggccaggcccacggccgggtcggcccagctccagcccgcccaggtgccgagcgcggcgaggacgaccgcgagggaggtgaagccgtcggtgcgcgcgtgcaggccgtcggcgaccagggcggcggagccgatccggcggccgacggtgatgcggtagcgggcgacgatctcgttaccggcaaagccaatcacggcagcggcgagaacccagggcaggtgcgtcatgggttgcgggtgcagcagccggtcaacggcgagccaggcggcggtgatcgacgaggcggcgatgaccagcacgatgacgatgccggcgaggtcttcggcgcggccgaagccgtaggtgtaggcgcgggtggcggcccggcgtccgagcatgaaggcgatgcccagcgggacggcggtgagtgcgtcggcgacgttgtgcagggtgtcaccgagcagggcgaccgatccggagaacaccacgatcagcgcctgcatgatcgcggtcgcgccgagcacggcgagcgagatccacagggcgcgcatgccgtcgcgggaggcttccatggccgagtcgaccttgtcggcgctgtcgtgcgagtgcggtgtgatcatgtgctggaggcgatgccagagtccctggccgtgctcgtggcctccgtgatcgtgatcatgtccgtggctttcaccgtgcgggtgctcatggccatggtcgtggccgtggccgtggtgctcgggtgcgacgccgtgcggttcgtggcggtgcgccggctcagccatcgcaatcgtcctcgtgctcgcgggtggtctacgtgctgtcaccgccataatatgtgctcatgcacgcacgcgacaacatggcaagtgccagtgacctgcaacaacgcgctgtgagtgacaacgtcatcggtgcagcaacgctggcgctggggatgcttgcggacgcgacgcggctgcggctgatggtcgcgctgctggccggcgagcaggacgtgaccgcgttgacggcagcggtgggcgcggcgcgtccggcggtgtcccagcacttgagcaagctgcgactggccggcctggtggccgctcggcgcgacgggcgccgggtgatctacgtgatcgccgacgagcatgtggcccggctggtgaccgaggcggtctacaccgccgagcaccgggtgtcggccagcccggaccatcatctgcccccgcaacgctgacccgcctcggcgaatacccagccggaaccgcagggaggcggtgtccgcccccgatcggctcccctgcctcgcgttgctgcgcacgatcgcagtgcgtctcagtacaggtagacgtcgatgaggaaggctgccaggccggcgagtgcggcggtggcggcgagccggcggccggttcccgcggcgaggggcccgaggccgagcgcgagcgcggtgaccgcgatggtgaacacgccgctgccggtgtcctgccacgaggcgggcaggaccgcgacgggcgcgtcggtgaagaactgggcgccgtgggcggcgcgcaggatcgcgttccacgccagcggcccgagcagggcgccgatcgcggcggtggcgatcacggccgggcgacgcggccgcacggcggcggcgaccagaacggcggcgagcagcgcggacagcgccgcgccgtagatcatcgtgccccaactgagcatgattcctcccgaactcgttcccgccagcgataccgtaaccacggttacattaccgagggtggacggggacgcgcgatggacacgacacgcaggcgactcctgcaggccggctggacagtcccggccgcggcattgaccgtcgcggccgcggcgcaaccggcgcgggccgccggcgatgaccatgccggggactgccatggccgcctcgcgccggtggtgaccgccgcggcggactgggcgccggtcgcgcaggcgctggggcgagagggcaagctgctcgacgacggccgggtctaccgggtcgggttcgcccgtcgggacctgaccgtggtcagcggcgccgtgacgatcaagccggcgttgtcgctggggtcctacgcggctttcacccgctaccgcgacggacaggtcctgctgatgggcgacctggtggtcaccgagcaggaaatgcccgccgtcaccgacgcgctgcaggctgccgggctggcgcagaccggcatccacaaacacctgctcgcgcacgagccgcagctgtggtggacccacatccacgccgtcggcgacccggtgagcgccgcccgcggtgtccgcgcggccctcgaccacactggcactccaccgcccgcaccggcgaacaccacccctggcgagctggacaccgccgccctcgaccaggccctgggccggaccggcgcctgggacggcggggtctacaaatacacgatcgcccgcgcggaaacgatcaccgaccacggccggaccctcaccccgggcatgggcgtcaccaccgggctcggcttccagcccgccggcgacggccaggcggcggtcaacggtgacatcgccatgcgcgccgacgaggtccagccggtgatcaccgccctgcgcggcggcggcgtagcggtggtggagttgcacaaccacgccctgcacgacgagccgcgcatgttctacctgcatttttggggccacgcggacgcgcaggccctcgcccggacgctgcgcgccgcggtcaacgccaccgccaccacgccgtaagcacctcggcacgagggccgcctcgtcagcctgggcgtcgctgtccggcttgctggtccgcctgtccgtgtgccggccgggtagtgccgtttcccgacgactcatctactgtaaccatggttacatcaatcgggatgagggtggtatgcggtgacggcacagcgcacggtggtgttcgtgtgtccccacggggcgggcaagagccggatcgcggcggcctggttcaacgggctgggcctgcccggctggacggcgacctcggccggcatggaacctcagcagcaggtcagcgtgcacgccgcacggctgctgcagaacacgccggtgctgccgttgctggacgaggcgatgccccggcccctgtcggcagtcccggagcgggacctgctggtcgccatcgactgctcccgcgagttccccgccgaccaccggtgggacctggagcagcagcagttcaccccgcagatgtgcaccgagatccgcgaccgggtgcaggccctcgccgctgctcttgccgggcagccgtcatgagccgaccagccgggcagtgggtgttgctgtcctaccggattccgcgggagccgtccgcgccgcgcatcgcggtgtggcgcaagctggaacgcctgggcgtcgcccgcctcggcgatggcctggtggggttgccggccgacgcgcgcacccgggaggcgctcgactggatcgccgacgagatcctgcaggccggcggatcggcgacggtgtggctggccgctccgaccacagccgcccaggaacgcgccatcgccgagtcgatgcgcgacgcccgtgccggcgagtacgaggccgtgcgactcgaagcgcaagccgctgccgggttgccggacaccgagcgggcccgcgtcgtgcgccggctgcgggctgagctacgccggatcgaccgccgcgacttcttcccgccggccgagcgcgacgcggcccgcgccgcgatccaggccctcaccggcgccgcaaccgacgtcccggtggaggaggacgcatgaagtgggccacccgtgccggcgtacacatcgaccgggccgcatgcgcctggctgatccgccgccacatcgacccagacgccgagttcgtgttcgtcaccgacatgacggcggtcccggccgatgcgaccccgttcgacatgcgcggcgtggatctgggccaccacggcgacgactgcagcttcgaaacgatcgtgcgccgctacgaactcaccgacccgatcctgtggaaactcgccgagatcgtgcacgaagccgacctcgacgacgaacgctacgacgcccccgaagcccccggcctcgacgtgatcctgcgcggcttgtcgatgatctgcgacgacgagcagatcctcgccctgaccgggccggtcttcgacggcctgtacgagtaccaccgccgcgccctgctgctgaaccgcccacctgcctgagcatcagccgtcacccgcatgcccgcccgagctccagaaaggcgctgatgaacagcaccgacccgtcgtcccacccctccgctgcgccaaccggcccggcaccggggcagcagccggcccgtgacgtggtcccgttcggcgaggccgtcaaggcgtggctcgtgatctcactgcagaccttcggcggcccggccgggcagatcgccgtcatgcaacgccacctggtcgacgaacgccgctggatcgggcagaaacggttcctgcacgcgctgaactactgcatgctgctgcccgggcccgaggcccagcaactggccatctacgtcggctggctgctcaacggcctacgcggcggcctgttcgccggcaccctgttcgtgctgcccggcgtggccgccctgctcgcgctgtcggcggtgtacgtcggcttcggcgacaccaccgtggtcaccgccctgttcgccggcctcgccccggccgtcgtcgcgatcgtcgcccaggcggtgtggcgcgtcggcagccgcgccctgaccaccaagatcctcgtcggcttcgcggtggccgcgttcgtcgccctcgccgtgttcggggtgccgttcccgaccgtggtcgccgcggccggtgtgaccggctgggcactgcaccgctggcggcccgccctcgtcgccggcggtggcggccatggcggcgcccaggacggcccccagccgttgatctccgacgacgcgctgcacgacgaccggccctcggcccggcgggcgctgaccatcctgacggtggggctgctcgcatggttcctgccgatcgccacggtcgccgccctcaccggggtcaacagcgtctacacgcagcaaggactgttcttctccggtaccgccgtggtcaccttcggcggcgcctacgccgtgctcgccttcgtcgcccagcgcgccgtcgagcactacggctggctggccgccggcgacatggtccgcggcctggccctggccgagaccaccccgggcccgctgatcatggtcgtgcagttcgtcgcgttcctcggcgcctaccaccatcccggcaccgtcaacccgtggaccgccggcatcgtcgcttccctgctcaccacctgggtgacgttcgtgccgtgcttcctgttcatcctgttcggcgccccctacgtcgaacggttgcgcggcaaccacgccctgtcggccgcgctgaccgggatctccgccgccgtggtcggcgtgatcgccaacctcggcctctacttcgccgtgcacaccctcttcaccgacatgcacgaggtcaccagcgggccgttgcacctgcaactacccgacgtcgccacgatccgcccggtgccggtagggatcgccgtggtctccgccgggctgatcttccggctgaaatggtcggtcctgcgggtcctgggcatcagcgccggcctcggcctcgccgccggactggccggcctgcccggcatctgacaaaccggcgcccccgggcggacgtcccggcccggttaaagatcactctcgcttgtgcctttcccggcacccgacccgcggcacctgtaggcgttctcacaaacggtccattgtgagaaccgtccgccgaccgacaccaccggcatcacttcgggtcggatttgttctcacaacgcgttctcacgcaagcgcgtcggtccgcgattctgagaaatgtttgtgcgagcattccgggcatggccgaacccgagaaccgcgaatccgactcgcgtgacgccgccgcgatcgagcggcacccgtgcccacgctgtctggcgcagcccggctcgccgtgccggtcgcgctccggcgtggtcgcaacctcgtaccacaccggccggttcaccagggtcggccggctgagcaaggccctgcgcgtgctcaccccggccggccgcggcccgggccagccgtggcggcccggcaccccgccgctgacgctgatacccgccgacctcccgagcgccgacatccggatcgggtacgcccggtgcagcaccatgacccaggagctccagtcacagctggacgcgctcgccgcgcacggcatcccccgcgacaagatcttttccgagaagatctccacccggatgcgcatccggccacagttcgaggcggccctcgccctcgcccgcgagatcaaggcccacgccccgcactgccgggtcatcctcaccgtcaacgagatgaagcgcctcggccgcgacgccgccgaactcaccgccctcgccgaccacctcgtcgcgcacggcctggtcctggagatgctcgccggaccgctgccgggcatctacgacccgaccgggcccggccggatcctgttcgcgttcttcgccgccctggccgagaccgaacgcgacaacatccgcgaaggcaccctcgaaggcctcgatgccgccgcccggcagggcaaacacggcggccggcccccggtcatcaccgacgacatgctgcacaccgtgctacggcgccgcgccaacggcgagaccgtcgaaaggatccagcccgacctgatcatcccaaccggcaagcgcaaaggccgcaacccgagcgtggccagcatctaccgggccatcgccgcgtacgagaaggcccagggctacccggacgccatcgagcaggcacacgctgagcacgcaaagcgagccagcgaccgcctcccggcgatcgtgcgcccccggcccgctcgggttctcgacccgatcgaccccgaactggccgcccggatccaaggccgccccctcgaccggatcgagtagccgctcctcaccttcacgccgcagcggaactctccaagatcaccgttagcgccagttttcgctccgatgctcctcaacccccgccaccggcgcggtcatcgcaggaccagcagtcgcggcgaagcagcggcgtcgccggagtcgtacgcaataggcgccatggaggccagcgaacccggcggcggggccgcggtgcaagagaaggtacgacatcgcaccgggagaagctttcagaagcggctgttggccagccagcggcgcagcagggcgcggtcgccggtggacgggcccggttcgcggcgccggttcagggtcagcagcagctccttggccggcgcgcgcagggtcacggcggcggggacggtgacgtccggagtgtcggtccaggcggcgccggtcggggtgagggtggcatgccaggtgtgccggccatcgctgaagcgcaacgtttcgccagcgccgcgcaggccggccatcctcggctgcgggcgggcgctgagcgtggcgcagcacagcaggatgtcgctgaccccgtcgacggccagatcctggtccaggtcaccgccgggcgccacgtcgaaccggtggatgatcaggtcgtgcagcatgcggcgcgcccagaaaccggcgatcggatacttcggcacccacgcccagaccgtcgtgtcgaagccgacgtcgcggaccgcggcgatcaggtccgcggcacccgaactcagccacccgggccagtcgtccgggtcgtcgggggccgggatcaccgcgtacgccggcggggtcggcgatggtgatctgatcacgccggtggccgtccgatggccggtgccgacgtgggtgaccaggtcacgcagcgtccagtcggggcaggtcgggatcggctccccggccgcacgcccgcggatcgcggtgatcaggcgggtggtctcggattccagggcggacagataccggtcaggagtgagccagtccacagttgtcgatgctacgcactccgcagcagccggtacacctctgaccgtgggcggcgccggatccgaaaattcgtgccacgccgcccgactccatcgaggccggcagtgttgctctccgggcacccggttccgggcttttccggcgggcacaggtgacgtcctggttcactcaacggcgccgagactgtcgcctcttgtgtgatcaactcgagccaacgccgccccgtggtcagagcgctccgagtccggctccgccggaccgtgcgccaatgcccgggcccggcacgccgacgagcagaaaagcagcggtgtccttacttcctcgaattcacgaaccgccgcttctcgcggtgtctcgccccgctccaccatgccacccgatagttcccactgccctcaagaccggttcagcacgagcagggtctcgccctcgtgcgtggccaccaccagcgcgagcggaagcgggatgtcggcttcgagcagccctggctcaatttccgcctggtcggaactccagcaattcgatacccgccgcatcggcggcgatgagtggggccatgaggtgagtattgctccgaagcgggcggtgcctgctgtttgattcccgacatgtcgggaatgcggcgccggacatcgccgaaggagttctccatgacatccacgtcgagccgcatcaccacggacgacgcacaggctcactggtacgaggagcgtgcggcgcaagccacctcaccctggatgttctcgcccgccgatgaccaggccacccggcgagagccgctctggtccggctcctgccacgacgcccggttcaccacggtgcagggccacgactcggtctgggtcctggccacggccggcgacggggcccgcacggccctgcgcgtggcgtactgtcccggcgggctgctgcgaacggtggacgtggagccggccggcagcggtgtacgcctgcgggtcgaatcggcgatcgggacgttccgcaccgagatcgcgctgccggattctgacgtggccctgctgcacgcgacgaccacgctgacgcccgccgccacgctgagcgtgccgtactggccccgggatctgatcccgctgggtgacggcgacgccctcaccgactcggccgggcgcgtgtacgcgtatcaggagggcgtgcgcaccggatgcgtgcacttcagcgtcacccggcccgaaggcgccggcagcatctactacttccagaacctcacggcgctcaacgactacgccgaacagaccaccacctcgctggccggggtggtgggcggcgcgtggccggaactcggcctgtccttgccggtctcggtggacaaccccctgcgtgcggggcaggagacggtgctgtccgacgcgtacgtgctgttctggccgtcgatccccgatgacgacacggggatggccgagcagttcctcgactcgctggcgcgcatcctgctgctgctgccgcaccgcgagccggcctacatgccgtggccggacatcgccgagaaagcgctgcgggacctgtcccaagcggccggctgcagcacccgcatcgacgggcaccggttcctcaacgcctacgtcggcgacgtcgatacaccgccggagagcatggtgcagctggccgtcctgctgccgctgctggagtacgcagagtggcgcggcgacgagatcgcgctgaccggcgaactgctggacgggctgccgggcttcttcgacgacgaggccggggtgatggggcgctggctgatggcccggaaggaccggctggacggctccgagccgcagaagaagccggggaccatggactcctggtacctgtaccactcgttgctcaacctcgcccggctggcacgccacggtgaccgtacggcccggcggctgttcctcgactcgatggacttcgccgtcgaggtggcgcaccatttcgagtaccgctggccggtgctctacgacatgtacaccctcgacgtggaggtggcccgctcgggcgaggacgaggccggggagagcgacgtcgccggcctgtacgtgcacgtcatgctggaggccttcgagctgacccaggaccggcgcttcgtcaccgaggcgacggtcgccgccgaccggctggcagggctcgggatgcggatgttctaccaggccaacgtgaccatgttcggctgcgccgcgctgctgcgcctggccgagctcaccggcgagcagcggttccgccgcctgagctacgtggccctggccagcgccttcaacaacacctggacctgggagtgcgactacggccacgccgctcactacccgacgttcctggccatgctgccgctgcgcgccgctccgtacatcgccgtcatggaagcgatcgaggccttcagtgcggtccagtactacctgcgctcgttctccgagccgatgccgtcctggatgacggtcctgctgccgcagttctgccgcggactgctggagcgtgcggccttctactacccgcagaacctgccggacgacgtgatcagcgacgagcaggagtcaggatcgctcgacgcgcggctctggatccccctggaggacctgcgcgacggctgggaacggccgggccaggtcgggcaggaggtgtacggcgccggtgtgcccttcgccctcgtcccccggcagtaccgccggatccccgaggccggcctgctggtcttcaccgactacccgatcgccgcgttcaccgtcggcaccggccgggcgacgctgcgggtgaccggggacgcccggttcacctgccggctgctgctgatccccgacgatcccgaccgtacgccgcaggtctcggtgagcgacgccgccgacggcgggctcgtgcccgctgaccgcaccagcgagggatacctggaccaccggctgcgcggcgaccaggccgtgatcatccgttggcaaccgactgagaacgaggagcacgtccatgaccgccaccgcgcagaagcatgaacccgccactgccctgctacccgagtcggtagccggcaagaacatcctgatcaccggcggaagcaccggtatcggccgggccaccgccgagctgctggcgtccgccggggcccgggtggcgatcgtcggacgccaccagccggaactcgacgacgcgacacacgacatccacgcggccggcggtgacgtgctggcactgcgggccgacctcaccgccgaccgcgacgtccagcgggtcttcgccgagctcgaccggcatttcggcgacgttcacatcgtgatcaacaacgccgcgctgggtgccgggtcgatcgccgagggcacgtacgagcagtgggagtacgtggtacgcaccaacctgctggcctacctggccgtcacccatgaggccgtcacccggatgagagagcagggcagcggccacatcgtctgcatcgggtcgatgagcgcggacgtacgcgagaagggcagctcggtctacgtggccaccaaatccgggatccagggcttcaccgaggcgctgcgcaaggaggtcaacgagttcgggatcaaggtgagcctgatcgaaccgggcgcggtcggcaccgacatgcaggcgcagttctcgccgcaacagcagcgtgagcagatcgaagcgatgacgatgctggacgcccgggacatcgccgcctgcgtgctctacacgctcacccagccgcgccgctgcgacgtcgtcgacatcaagatccgtccgcaccggcaggagatctgatccaccgcccgtgtggccgcctcatgccgcggccaccgccagttggtccgcggcgcgcggcacgctcgccacggcggacgcggcgaccggcggcaccgctcgctgccggcgggcgctgacgagcaccgtgcacaccaccagagaacaggccagcccggtcagcgagcacaccagcacggcgccctggccgaggctgtaggcgtacgccgcccagctgaggttcgccgcgctggccagcacccaccgcagcccggacactccggacaggtcttgccggcggtcgcgcagcagggccagcggttgcggcacgttggccagcacgaccgccacggtcaggaccatgcccaggaccgacgcgagcgtgcggtgctcaccgccgggcaggctcgcgagcccggcggtgagcgccgtggccgacagcagcaccgccgcacccacggcggcacgcgcaccgaaacggcgctgacgcagctcggcgcgtgccgcgagcagagcgaccagcaccgcgattccggcgcccgcgcccaccgtgttggtgtagatctgcaccgggtcgtcgatcagcagcccgtactcgacccatcccaccggcagcgcgaatcccagccaggtggcggtgggcgacaacccggcggtgcggcgcagcacacacgagcgccacacctgcggccacatcagggcgatcgacaacgccgcggcgaaccagcccagcacagcggagaacatgaacctacccatcgcagacatgcgacggccgggtgccagccgccggggaacgtctgctgattcggcccgcgtcacgagccgctgagtcgagccggccggctgctaccgaccgggacccgagagcaaaccggggtcaggtcacacgctgatcgccacgaagaccgccccggtgccgctcttgtcggccgcggtctcgaacgcctcgttgatgcgttccagcgggaaccggtgggtgatcaatcgctgggcgtcgagcatgccgctggccagcaggtcgaccaccatgccctgttccgggtcgagctcgtgcacggcgaaactggcgctgggcaggatccggatttccgacttctggatgtcctgccacggcagtgcgatctccacgtcaccctcgtcgaagccgcccaccaccacgaccgctgcgccgcggcgcgccgcccgggtggcttgcgggagcgtcaccggcatcgccgggccgcccacgcactcgaacacgacgtcagcgccccgaccgcccgtgaactccatcacccgggcgacgacgtcctcgttcgcggcgtcgacgacggcgtccgcccccagctcgcgggccatgcgccgcgacgacgccaccacgtcactgatgatcacccgggcgccggtggccttggcgagcatcagttggcccagcccgatcgggccggcgccgagcacggcgacccggtcgccgatcgagagcccgctcagatgctgcgcatgcaggcacaccgaaagcgtgtcgacgagcgccgcctcctcgaaactgatccgctccgggagccggtacagcttcgcccgcggcgcgacgaggaactcggcgtaggcgcgcgagacggtgcgcgtacgcacgtcgtacagatgggggcagatgttgtagcggcggacccggcaccatgggcagacaccgtcacccatcacggtttcgaccaccacgcggtcgcccgggttcaggtctgacacgcccggtcccacctcggcgacctcgccggccacctcatgtcccatgacacggcccgtcaccgcgggatcggggaccttccagtgccgcagatccgttccacagacaccggccacacgcacccggatccgggcccagtccgggccgggaagctccggcgagtcgacttgttcgacggtgaatgtcccgtccgctgtcttgaccgctgcccgcatgcgcggcgcctcctcgatccggttcgcgagccggtcgcgcaggcgagtggcacgccagctcagccgggggccgactcttcgcactctacggatcgccggggccgcggatgcgccaatccggatcatggcggtcatgcccggccggggcgtgatgacgaggcccgtcgtatagaaggccattgagactggcgggctccgttgatcgagtagtcggagcctgccagtctcaatggccgtgacggggtgcggcgtcggaacggcctgctggggtgccggtaagaaacctgtcaccagccgcagatgacggcctgtatgtgcgttcgcttaatgggtgtctgtttcagttcgcgtctgtccgttaggggcgtcggctgctaggtccagtgctcggtacagcgttgaccggccgacgcccaggtgcgcggcgatcgcggtcacggattcgccgcgggacagccgggcgcgggcgatgtcgagttggtcggcggtgacggcgaccggtcggccaccgcggcgcccggcggctgcggcggcgcgtagcccgtcgagggttcgttcgcggatcagttcgcgttccagttcggcgaacagcagccggtcggcgatggtggctccgtcggggcggtggacgccggcgcagacccctgtcaggatctccagcacgatgccgcgggcgtgcagttggtcctcgacgaagatcagcagctccttcatcgaccgggctactcggtccggcttgtagatcaccagggtgtcgcccggctgcagccgggcgagggtggcgcgtagtttcggtcgatcgcctcgggtgcttgccgtttccaccaccacctcgcgacagtgcgcgccggtgagggcatccagctgcgcttgatgatcctgggcccgagtcgacacccgggcgtagccgacgcggatccggttgtgcggatgctcgatgccggccgggatgccggtaggggcagtggtcatgcccggcatcgtcccgcaaacgtcccacaaccaggatgaatacacgctggtttcgggacggattacgggactctgcgacctgcggaaacggcggcgatcgtggctgcaggtccgggcgtcccggaaaccctcgtttgcgagacgactccgggaagccggcacggacacagttgtcgttcatccggccgcgaccggccgcgcatgttggcatgtgcggctgtgggggttcgacggttcgcctgccgggcacctgtcagcgtcggggttaccgtgaaggcggccggtcccgacgcaccggatcgtgtcgactcagccgtccagccgcactagccgttctccaggaggttgttgatgggtgacgccggcaacgcctgggttaccgtgacgcggaccgatcgtgccggcgtggtctgcaccgtccatggggatgtcgatcaagacacccgtgctgtggtgacgcgtgaactgttggcggctgtcaccgcctcatcacctccggacgtggtcgtcatcgacctgagcgccgtggcgtttcttgccgccgcagggttgcacgtgctcggcgaggttgccgcagtctgctctgagcggcgcgttccggtccggctcgtcagcgccccgggcgcctgcactaccagagtcttgcagctgtgtccgcccggtggcgacgtgccggtgttcggcagcgtggccgatgctctcgccctcggtcaggcggctcatgcaccacaaccatcggcgtcggcggtgcccgaaccacttcaccgcttcgtcggcgctcccgcgctgccggcggtcgcgggaccggcgtggcgcagtcgccccgagcaggcgatcatcgacgccgagatgcgggccagccggcgcgcgatcctggcgctgtttcgccgccggttgcgcaccgacgtggccacgctggtcgcgccggatttcctggtgctcgccgacgagccactcgtgttctcggcgatcactaccgcggcgttcggtgtcgccgatgcctgtgatgtgcagacctacgacccggtgacccggtcgttgcaggtggttgcgcagcggggtctgccgcgggccttcgtggagcatgtcgccacgctcgacgtgacggccggttccgcggccggggtcgcggcgcgcaccggtgaaccggtgctcgtcgacggcgtcgcggccagccgggtattcgacggccagccgacacgcgaggtattgctggccgccgggtcacgtgctgtgcacagctatcccttgcacgacgaccaccgccggctacgagcggtcctgtcgctgcactatcacagtgcgggacgccatcccggtcaggagttgctcgcctggtacgccgagcaggcactctcccgcgttgccctgcctttcacactcgcagccgatgccgggcagctcatgacagagtcgatgagcgccggcatcgccgtggccgcctctgatgcgagcaccacgacgatcaccgtgtccggatcgctcgacgccagcaccgcccctgagctgaccgacctcatccatcagacgctgaaccgcctcacgacgccccatgcagtccacatggacctgcgtcagctgcagcatctcgcggcggcgggcgggcgcgccctcatccaggccgccgagcgatgccacgcccatggggtcgactgctacctgatcatgggcgccgatgatcccgcccgcaccgtgctgacccggctgcaagcacccagcagcctgcgcatcgtcgaggacgtgcacctgcttcgtggccagcaggggcaaggaccggccgcgccgtaagtctcgaccgcgacgtcgtcctcgcccaagggtcgcgacgctagtggccaacccagccatccgcttgtgtagacctctaccgcgacagccacgacgcgctaccggtgcggcaacgtcgcgaggtaagttccggccggcgcggggagtcgctgcgcaccaaggcgtttgatcagtgagatggtgagtccgtgcagaacagctcagctaacgacctcgatggcctggtgggggacgcgcagaccgtccggcacaccttcgagtccatgccgttgatcatgattgagtgggcgggtagcgaccaccgcatcgccgccatcaacgcggcgttccgccggatcgtgggccgcgagcacgagcggctggtcggcctgccgacgcgtgaggccacgccggaactcgccggtcagcaggtcttcgagatgttcgacgaggtctacacgaccggccgcgagcaggtagcgcgggaatggcgtttgcaggtcagtgccggaccgggcggcgagctgcgggaaatcttcctcgacttttacctggtcccggtgtacgacgacagcggtgcggtggtcggcatgcgagcgttctccaccgacgtaaccgaccgcgtacgggaacggcaggcggcccaggagcgcacggcggcggccgaacatcgctatacccaagcccgcgacgtcatcaacgccctgcaacgacagctgctgccccccgggttgcccgtgctgccgtcggcgcggatcgcgggcagctacctgctcgccgacgccgaaaccgccgcgggcggtgactggttcgacgcggtgccgttagccggcggccgggtggcgctggtcgtcggcgacgtggtcgggcacggcgtcgccgcgtccgccgcgatggggcagctgcgtgcggtgctgcaggaccggcttgacgacagcggtgacattctgaccgcgatgggcgcggctgaccggatggcccgtcggatgccggccgcccgcgccgctacggtgtgcatcgtggtactcgaccccgtcgacggcgcactgagctggtgttcggccgggcatccgccgccgctggtggtcaacgccgacgccgcccggttcctgccttcgtccgggaccgccccgctgggcaccggcgggcgctacaccgtgtccagcgaccagttgcgcgccggtgagatggtgctgctctacagcgacggcatcatcgaacgacccggccgcgaacccgccgccgccaccgtcgagctgtcccaggtcgccgtcgacaccgtcgccgggcgcggcatggacaccgacgacctgtccgccgtcgagcgggcctgcacacagattctggaactactggtccgccgaaccgggcacaccgacgacatcaccctgctcgccgcgcaacgccgcacgccgtcaccgccgctgcacctgagcggtccgacagcaacagtgaccccgcgggctgcccgggccgccgtcgaggactggctgaggctgcatgaagccggggaagaagaccttgtcgcgctgacgcacgcggtcggcgagctggtcaccaatgccgacgagcacgcccggcccgacaccgccgacgccacggtgacggtcaccgccgaactgcgcgacgacggcgaggcacgactgtgcgtcgccgacaacggccgctggcggcaccgcgaccgccccggcgacgagcaattccgtgccggccatggcttcggattggccatgaccgccagcttcgccgatgacctcgacatcgaccgcggtgagcacggcactaccgtcagcgtgcggcggcgactgtaccgcccggcccggctgctcaccgccgaacagatcaaccacgagcgtccccccgcggacgaagcgccgaaagtgatgatcattcttgatcagccgcacgctgccggcagccgcatcgccatccacggccccctcgacaccgacaccgtcgacaacctgcgtacagaactggaccgatacaccctcgggggcacccacgagctgaccgtcgacctcaccggcgtcacccacctcgccagcgcggccgtcgccgagctgtaccggccacagcagtacgacccagcacgcccctacccgctacgcctctacgcgcccgccggcagcaccgcccaccacgtgctgagcctgatcaacctgccccacaccaccaccgaccccgacggcaacgacaacgatccgcaaccgccccgataggccgccagccctgttttcaccctttggtccatcacgtgggccagtaggtcagcccagcggcagacggctgctcatatcgagtttgacctcgccgtacagggccacatgggtccagaacagcggggtcaggccgcgccggtcggcgtcggtgagcgtgccggcccagtcggcgtcggccaggacatcctggaccatgagggtgttgacgtagaccagagcggcctggagaacgcgcaggcacagtacggacagttcctgctcgccgcggcggttggtagcgatgtcgccgcccttgccgaagaagatcacactgttggcccggttccacgactcgacgacgttgagcccttcgttgatctcgcgttgcaggtcccggtcgcgcaggtagcgggcgacgaagatggtccgctgggcacggccgacctcgatcatggcctggtaggtggggtggatcgcattggcccgggtgaaccggcgcaggatcgcctcggtggaggcggtgccggcccgagccgcgggtacgcgtccgcctcgcccgcggcaggccggtagagccggaccttgttgatccgcttgatccggggcagcaggtcgaaaccgggcagccgggtaatgccgaacccgacctcggattggctgtgggagtcgacgtagttgccctcgacctccatggtggtgccgtgccgcatcgcgccctcgaccatcgcggcgacctcggaggcggtgcagttgatcagctgcgagtgaatggccatgctcttgcgctcgacgtgccagtagatgagcacgccgcggccgccgtagcgcgaatgccactcggtgaagatgttctggtcgaacgccccgaagtgggtggagtccgacgccaccgcggtggagccggcgtcccacacggtctgtgcccgggccgcgaaagtggcgttggcgatctcaaccgccagcgccgtgctgcggtgatgccgatccgcgcggatgcacggtgcctccgatgatcttcgagtgcaccataactgtcactatggtgcatcgccgttatgtccgtttcttgcggtctctcgtgttactggattactggtaattgtaatgcaataatccggcaagttctgtcagagcgatcctgctcgggttttccgggtgctgcgtccggatcgaaccgctgttcactgagcggcacggccaaggcgtggtgcccacattccgtccccgagcgacctgctacggctcttgactaggcgccgggacagtccgagactcgctgaacgcgatcgacctgctctatcgccgcgagggcggcgtctgaccttgccggcctctacgcgattccgacgcggcgggcgagggatgggcgggttggtcatgtaatccgccatgcaggcttgccgccagtcacaacggcgatcgggagcacgtggtggcttgcatgtgggggtccatgacggcaaaatctccccatgatcaaaagaattgagctctccggtacccggtgaacgcgttcgaggcccgggtggaccgggtgctaggtgctggccccttccgcgaaatcggtcgtccacgcgttaccgcgatctcgccccatgaatcgcttatcgcggtaggcgggtcgctggatcggccacaatggcacggtcgggacgtctctgatcgttcacgaccgcatccgggttggcacccgacggcggtctaccgctccgacaacctgacctgcgtgttccatatgaccacgcgatggccagccaacgcgctcgccttccatcccaccctgccgttgttggcgatcggcaccggcgcgtacgacggcggatggtcctacaacggcgaactgctgctgctggacctgaccaccggtgcgaccgtgtcgctgctggccgatccgcgggaggtccggcagctcacttggcaggatccagaaactctcgcactggtgctcgctgttccgtgcgacgaggatgaggagcggttcggtaccacatctctggcctgcaccatccgccgcgacgactggagccgggccaccgcaggcatgcttcgtatgccctacggcgaagagccgtacatggacgaatgtcgaacgggcccggctgccgctgccgctgccattgaacggttgtgctcagcacgaggacttgcctggacgccccgccgcgccgtctgggcggtgcaggcactcccagacggccgtattctcgccgccctcgaaggtattgctctggagtgctggacaccgacgtccgagagccccgcctggcaggtgcccatcgacggtaccggttgccaggtcaccacgctgccggacggacgaacagcggtggcgttgacacaaaccccacccgccttccacggcggccgatggacgagtgagccgagcgtggtggtggaggtcgacctcaatgagggcacggtccgaaatacccgccaggccgcctcgcccgcaatcgtggtatcccgggctgacggccggtgggcgttacgcaacaccgaacacgacaccgcaacgatgaccggcgaggtcacattcatcgatcctggtgatgcccagccgaccacggttcatctgggtcgttacgacctgttcaatcactacttcgacatccggtatgcccccgacctgctcttcctgcaaggtgtgggcagcaaaccctggcgtgacaagtgggtggtcgccgtcgatgtgccacgcgggcggatacggcggctcttcccgctcgagtgggatgcgtcgcgcggtgggcacctattcggtggctgtggcgcctacctcagcgaccgagccggccccgcgctcctccacaccggtgccgttcacgatggtgcgggactgttgaccgggaacgctttcgtggcccgtcgcgcgtatccgaccggcgagctgcaatgggtgttcaccgccgaccatcaggccaccgcactcgacgcagacggcgacttcgtctacgtgacgttcaactcgggagagctggtcatcctgcgcgccgtggacggcgcggtgcaggtgcggcagcagctccaggtgaacgggtaccgggtcattccgctctcactggcacgggtgggagcgaaccggcttgtggttggcacgctggacggtcgtgtactcgactgttcgatcgccgcgctgcctcgatcggggtaagaggggctcggttcggatccgtgtgcacgagccgagctctttgagggagggctccgtattcgagcccggtgttgcgtttgagggtcgcccaacgctccatccgctcccgctgcgccgaaggcgccctgtccctggcgacctcgcggaggaatacagcgtcggccgttccgctgtccaggcgacccggcatccggcagccatgaagaggcgggtcccgagatcaactacatctcctctgaccagccttcccgctagtcctcacgagatcgttggtcgagggccgggatcgggggccacttcataccggccgcgcgggagcagggaagggcgtcccgcgcggccggtgtcgatcagccggcgagctggccggactcgacgggcaggccggcggtcacccagtcctggatgccttcgcggtacttgcgcacgttggtgtagccgagggcggtgagcttgtcggccacccgctggctgttcgggcaggccgggttcgagcagtaggtcacgatcggcgcgtcgcggtcgggcagcagctcgccggcgcggtccgcgacgtcggcctccaccagcgcgatggcgccgggtaggtgctgctgagcgtagtagtcgccgccgagggcgtcgacgacggtgaccgtgcccgcgtcgatctcggcgcgaagctgctcgcgggtgatgagggtggtcatggcaacctccaagtgatcggactacagtccggttatgcctcaggacattagcggaccgcagtccgtttacgccagcgcggccgaggaactcctgctgttgcgcagctcaccgccgaccgagcgggccgacgccgcccgcaaccgggccgccgtgctggacgcggcagcggccctgttcagccgacacggcatcgaagcggtatccatggacgcgatcgccgcggccgccggcgtgggcaagggcacgctgtttcgccgcttcggcgacaaggcgggactggccgtcgccctgctcgatgagcaggagcgcagcctgcaggaggcgatcctgttcggcccggccccgctcgggccgggcacgccgggcgacgatccgggcgtccgcgagcggttgcgggctttcgtggccgcctacctcgactaccttctggcccatctgccactggtacggatgtcggagaccgcttcgcccggcgcgcgctaccggatcggcgcataccggttctggcaccggcacgtctcgctgcttctgcaggatcgcgatgacccgcaggccgacgcgcacaccctgctcgccgcactcgccgccgatcacgtgcacgccgtggccgacgaaatcggtgccacccgggtacgccaaagcgtgcagtgcctcgccgacgtcctcaccgcctgaagccatcggggcgaaggaaggtcggtacagctgtcggcggttctccccccgcgcatcgccgatgtgggcggcaccgggttctggcgtcaggtccgcgcctgccccgctcgggcaggccctggccgcatcatgcggccctaccgcgccgggcaggaggaccggcgcggcgcgggcatgagatcagcggccgtttctgcggaattcgggaacgggcaggcccccgatgccccagtcgtcgagctccacctcgtcgatgacgacgaaggtcgtccgggggtccttgccgagcacgtcgacgaggacctgcgtcatctcaccgatgatgcggcgcttctgctctcgcgtcacaccctcacgagtgattttcacattgatgtacggcatggtcagtcctttccgtggcgtcggggagtcgcgtggaacgccttggtcacgatctgccagcgtccgtcggcgtcgagcagggtcagcacgtcggtgtagtcgacgtcgcccagggagcattcgacgacggcgacgatgagactcggggcgacctgcgtgatcgcaacgatgcggtcgttgcgggcttcgccgcgtgctgcgggagccgtccggtgtgccaccacgtcgaggtaggtcggcaggtcgcggtgcagcgtgccgtccggggtttgagtgatgtagagcgcggcggggtggaagacggccgcgagacggtcgacgtcgccgcggtacaacccgtcgaagtaggtcctcagcagcccctcgacgtccgggaatccgacggcgccacccgcgggagcgaccgtcatgaccgcaccgtgacgaagccgccgtccaccgcgagggtgtgaccggtgacgaactgtgccgtcgcgaggtagtgcaccgcctcggcgatctcgtcggcttcgccgacgcggtcgagcacggcaaggccggcgaacgcgtcgacgtcgacggcggcgtgcagcggagtccgcacgacaccgggggccacttcgttgacccggatcgcgttcggtgcgagctcggccgcgagtgccacggtcaacgcgcggatcccacccttggaaacgagcgccgcggacgccgggaagccgctgaccgcgtggtcgttgagtaccgtgccgatgttcaccacgcagccgccgcggccctgcgcgaccatgcgacgaacgactgcctgggtggtgaggtaggtcccgcgcagattcccggcgaggaagccgtcgagttcctcgccggtcacgtcgaggaacggcttcgcggcgaacgtgccggcactgttgacgagtacgtcgaccccaccgaaccggtcgacagcggtgcggacgaggcgctgtccggtgtcggccgcaccgatgtcaccagcgaccgtcgccacccggtcgcccgccgacaggtcgtactccgcctgcttgagccgcgcatcgtcacgtccgccgaggaccacctggtaaccgtcggcgaggaagcggcgcgccgcggcgaggccgagaccactgctgccgcccgtgatgatcactgtcgaggaactgctcatggctcatcctgtcgtcgaaggggaccggtcggatccggccggcccgtcaagcagtgacgctacggagaaaccaaccgatcagtccaagacgcggtgacctcgaatgtcataagctcggcttatgaacgtggacgtgcgggacctggagttgctggcggcgctggcgagcggggggaccctgcttcaggcagccgaggagctctatgtgagtcagcccgcgctcagccagcggctcgccaagatcgaagcgcgcgtcgacgcgcagctcttcgaacgccgcgggcgccgcctggtgcccaccgaggccggcagacgcctcacggtcagcgccgtgcacgtgctccgggaactcagcgcggccgaaaacgacgtacgccgcatcgcgcaattcggacgcagtcgcgtgcgggtcgcaacccagtgcagtacgaccttcggctggctcaccccggtgatccgccgccaccgtgaagatcaccctgacagccaggtgcgggtggagtccgtgccggatgacgacgtcgtcggcgcactgctcgaccagcgcctcgacgtcgcggtcctgaccaaactcgaccggcgggcggaggagctccagctgaccccgctcttcgacgacgagatggtcgcggtggtcgcgccgcaccatgcgtgggcacggcgcgaccatgtggcgccgcgcgacttcgcccacgtcgatctgatcttgtatgactcctacgacccggcccgggccctggccacgccgctcccgctgccacccggcgcccacccgcgcagcctcacgacggtacccatggtgacggacctcgtcgtcgagcttgtcgcagcccaggagggcgtctcggtgctcccctcctgggtgatcgcgccgtactccgaacgcggtgacgtcgctgtggtgcgcatcggcgcgcggccgactacacgcacgtggtacgccgctgtgcgcgccggcgacgagcgcgcgtcagtacgcggattcatcagcgccctgaaacagcacttcgccgcccagggccccggcgaggtgctgctgaacgcggcgggcggctcgggtcacctctagtacgggacatgtgctggttgcaccggcgctcccattcccttctagaggacccgtcccgccagggcgctctcgctgatcgggccgtactggcgggagtcgaaggacaccgtccggtgatcgccgagcacatacacctggtcggccggcacggtgaccggcgtgcagtcggtgccggaccagcccgggtccgccggcaggtacgactcgtcgagcggcctgccgttgcgccacacctgcccgtcgcggcaggtgatctcgtcaccgggcaggccgatgacgcgtttgatgaccaggcggtcggtgccgggcatggtgaactcgacgatgtccccccgttggacaccggtgagccggaacgccacccggtcgagcacataccggtcgccgatgtcgtaggcgggctgcatgctgccgctcggctcgtaccccacggtcaccacgaaccggttgaccagcaacccgccgacgatgccgatcagtgcgatcagcacggcccgccgccggatccggaccatccgcgggagttcccgcacccgggcgcgacgttcgtagcgggccgcgcgcagcccgccggcggcccaccgtacggccgcccagtctccggtgaccagggggaattcggcgagtacagcctcaccccagtcgccgccacgatcccggcggccgcgcaccgcggcggccaggacggcatgcgccatccggcggaccgcgctcatgctgtccgcgcctgaatggcgccgccgagacggcgaaccggttcggcggcgggtttcgccgcggccagacgctgctgcgccagggcggccccctccgcgctcagccggtacatgtgccgtggtggacggcccggctcgtcggagggctcccacctggtctccaggaggcgctgctcgctcaggcgcatcaggatcgggtagagggtgccggaggccagggtggtctcccggctcaggtcgtagccgtaccgccagcgttgcggcgcgtccagcagcgcgctgaacagcagcaacgtctgcggtgacgtatgcggtttccgtggcatgcgcgaaactctacataactcgaccaacgaagatcaagtgaagtggcagccgagctcgacgaaggcacacggcatgacccggttcaacggcccggtcggcgccctgaccggcaacaagccgatgttcgacaaggtcaccttcacctggctcgccgagtggctggtaccgatcccgccgaccgccgaggccagggtgacggttctcgccggcctggtcggccgccagagcgtgcagtagccacgccgtcagtcccagcagagacagaacggcttgccggccgggtccgcgtacacccgccagttctccccggaggccgccagggcggtcgcgccgagcttcagcgtggccgcttcggcccggtcgatgtcgtcgacggtcacgtcgatgtgcacctgctgcggatgcgccgggtccggccagcgcggcgcccgatagtcggccacctgctgaaacatgatcggctgcgcgccgtcctcgccgatcatcgccatgccctcaccctcgtatgtgacgggtttgccgagcagctcggcgtagaacgcggccagccgcgacgcgtccgggcagtccagcatcacgcccatcagcgtcgtcgccggcgcacccgcctgcaggcacaggtcgaacggatgcccggccggatcggccagggtgtgccacgtctggttctcccgcagcagcgtggcacccagctccacggcccgcgcggcgccggccgccaggtcgggcacccgcagatccaggtgggcctgctgcggaaaccgcggatccggccaccgcggcggcacatgatcgggcgcggcctgcaccgccacccgccaaccctcggcggtgcgcagctggatccagtcgtcgtcggcgtactgctcgctccacccgccgagcgccacatagaagtcggcaagcccccgatggtcggcggcatccagcgccactgtccgcaatgtcccggtcatcgctccatcatccccgtttcccgctcccgcaccagccaccaaaccccggatcaccatccgcttgcgggggtacgcggtgacccgcccgcccgctgccgcacccgggccgcctcccgggtcagatgatcgcgttccggcacactgccggcctcccgcgccgcccgtgcatacagccgcgccgccgcctgcacgtccccggcgcgctcgcacagatacgccttgaccgccgcgtaccgcggcacctgctcccccaccgcctgcagggccaccagcccggcccgcggcccgtccgccgcaccgaccgccaccgcccggttcagccgcaccaccggactgtcggtgatccgcaccaactcgtcgtaccactcgacgatctgcacccagtcggtatcggccgcccgcggcgcatccgcgtgcaacgccgcgatcgcggcctgcgcctgatactcccccagccgatcctgcgccagagcgttctgcaggatcagcaccccttcaccgatcatggcggtatcccacagcgaccgatcctgatccgccaacgggatcagccgcccgccctcgcccgtccgcgacgcccgtcgggcatgatgcagcagcatcagcgcgagcagccccgccacctccgggtcggcggtcagcccggccagctgccgcgtcagccggatcgcctcggccgccagatccacatcgccgctgtaaccctcgttgaacaccaggtacagcacgcgcagcacggtgcccggatcaccgggccggtcgagggccaccccggtgatcttcttcttggcgcggctgatccgctgcgccatggtcgcctcgggcaccagatacgcggcggcgatctgccgggtggtcagcccgccgaccgcccgcaacgtcaacgcgaccgccgcgctctgcgacaggctcggatgcgcgcagagaaaatacaggcgcagcgtgtcgtccacgcccggcgccggcccggccggcggctgtgcgtccaccgcctcctcccgcccgcgccgcgacgcgtcggcccggaccgcgtcgacgaacttgcgccaggccgccgcgaccagccacccttgcggatcccgcggcggatccgcgggccacgtctgcagagcccggatcagcgcctcctgcacggcgtcctcggccgacgcgaaatccgcgccacggcgcacgaggacaccgatcaccgccggcaccaggtcccgcagaagtcgttcgttcatctgatcccccagccccgcagcatccgctcgttgcgtcgtgccgatggccgggtgcgctcgccgggccggcaccgggggcggcgggtgctcgcccccggtgcacacgcggtcaccacgtcgcggggcggccgccggcccccgccgtcaccggcgcggaccgtggccgcccggtcattcggtcaccgtgggcggctcggccaggaacggccggacctccagccactcgtggatcggcgcgccgccctggccgggggccgcggacagttcgccggccagggccacggcccgctcccacgagtcgacgtcgatcaccatccagcccgcgatcaggtctttggtctcggcgaacggcccgtcggtgaccggcggccggccctcgccgtcgtagcgcacccatgccccggtgggcgccagggcctgcgcgtcgacgaactcgccggtggtttccaggcgggcggcgaagtcgcgcatgaactggatgtgcgcgtcgacctcctgcggcgtccactcgtccatcggcgcgcagtcggccgccggcttcggaccgccccggtagtgcttgagcagcaggtatttcatggtgtctccctacgtcggcacgacccgtggcgggccgtcgcacccctgggacggagccgctcccgtattctcgacaccccgtacgacaattttgtggaaaagatcgtcagcggtcggtgaggtcgtccatctcctcggcgtcggcggtcgcggccgcgggccggttggcgccggtccggttgatgccggcgttgctgctgccgtcggccggtgtgccggacgtcggcggcgcgtcggtgaggaagtccccggtctccggcagcccggagacgtgctggtcggtgctgccacccgcaacggtttcaggttcgctcataccgggacccttacccggttcgcggctgattgttaccgtctgaagcggatacgccgccttggggggaccgggacgtgacgacgacgctggatgtgcacgggatcaccatcgcctaccgtcgcgccggcgacccgggcaacccgccgatgctgctgctgcacggcctgggtgacagctccgccgactggcatccggtcctgcccgacctcgtcgagacccactgtgtgtacgcggtggatctgcgcggccacggcgacagcgcccacccgggcacgtattcgttcgagctgatgcgcgacgacgtcctggggttcctcgacgccgccggcatcgagaaatgtgtgctggtcgggcattcgatgggggcggtcgtcgcggtgctgctggcgttgcgtgccccgcagcgggtcacccacctggtcctggaggacgcctcggtgccccggcccggtatgctgcgccgcccgccgctgcccccgccggtcgagccggtcccctacgatgtccccgtcgtcaacgcgatccgcgcgcagctggaccagcccgacccggcctggttcgaggcgctcgccaccctgcccgtgccgaccctgctgatcagcggcgcggagagcccgttcccgcacgagctgctcgccgattccgccgaccggatcccggacgcggtcctggccaccgtcaccgccggccatcacgtgcatctggagcagccgaccgcgttcaccaccgagatcgcccggttcctcaccggccgcgtcccccggtgaccgaccggccgcccacgccccgcacggaccgggcctcgaacacccgggagaaccagccgggcgcgtaccgccgcatagtggtctacggcgtgaccggctccggcaagtcgaccctggccgcccggatcgccgcccgcaccggcctgccctatcacccggtcgacgacctggcctgggaacccggctgggtcgaggtccccgtccccctgcagcggcagcggatcgccaccatctgcgccggcgactcctgggtcctggacagcgcgtacatgtcgtggctgcaggtgccgatggcccgcgccgacctgatcgtcggcctggacctcccgcagtggcggtgcctggcccggctgctgcgccgcaccctcgtccggctgctgctgcgcacccgggtctgcaacggcaacgtcgaatcgctgcgcgaactgttcacccgcgattcgatcatccgccagcagttctcgtcgtacccccgcaagcgcatgcggatgcgggcctggcacctcgacccggccatgcccccggtcgtcctgctccgctcgccgcgcgccgtccgggcgtggctggccgcactgcccccgggcccgggaccggcctcctccggctgacgtgccggccacccggagcccgcccggcggcgaaggtgttcgcggcccggccgcagtcaccttcgccgccgcccgccgacagcatcctcacccgagctgtccgaggatgatcgaggcgccggcggtcagcaccaccagacccagcgtccgccaccccggcagcccggccccgcgcaggcaggtgacgccgtgcggcaccagcgccaccgccagcccggcgacctccaccaccgacgccacggtgctgcccttgagcaccccgatcatcagccccgacatcaacgccagcgcgaccgcctgccacgcccgcaagacccgcgacagccggccgccgacggccagcacgatccaccccgtcatgatcgcgacgctgaggctggagaccacccactccggataccggtagtaggcgccgaccgcctgctcggcgacgaccggcccggcactgccggtcagggagaacgcgaacgtgtcggcgccgtgctggaagacccgcgcgaacagcccggtgatcaccagggtgccgccccaccggccccagccgggccggctgtccgcgatctgggcggcgagcatggcgatgcccggccacagggcgatgatgccggccagcgccaacgcgtacgacgtaccccacaatcctggtctctgctggtaggcggcgatctggtgggggaagaagaacggcacgccgagccgcagcgcggtgccggccagcagcagcggcggcccggcgatcagggacaggccgcccagccgcggcccggggaacacgagggtcatgccggacaccatgccgccggcggccggtgccgcacatcgggccacggcatcgacaacgggcacgccggtgcgacccgaggatgagcgacccgagacggatggcatcgacgccggttgccggtagcctgacgtcgtgaccgcagcgcgcgcaccgatggtggatgtggccgccgccgtcgccgtcctcgccgcgtgcggggtcgcggcgcaggaggtcgggccgcccgccgggtggcctagctagctagtggccgcgccggtcgcggtgcgccgccgctggccggtgccggccgcgttgaccgccctggccgccgccggcgtgctcctgcggtccgggatcgtcccgtcctacgcggcgcccggcccgatcgccgcggtcgccctcaccctgtacgtggtcaccgcggtcccggtgctgatcgccggcctggccggtgcggcgctgctcggcccgctgtggccgaccgtggtcgccgtcccctggctgaccggctggctggtccggcaccgccggcacctcgccgagcagctcgccgagcaacgctccgcccgcgcggtcaccgaggaacggctgcgcatcgcccgcgacgtgcacgacacggtcgcccacagcctcagcatgatcaccatgaaggcgagtgtggcccggcacgtcgccgcgacccgccccgaggagtccgcggccgccctggaggtgatcgagacggcgggccgggaggcgctgctgcagatgcgccgcaccctcggactgctgcgagacgagccggccgacctgcacgctctcggcgaccgcgacggggtgacgatgagcgtggccggggaggcgtcgctgccccccggagtgcgcgcggtggtgtaccggatcgtgcaggagtcgctgaccaacgtgacccggcacgcgcccggcgcggcctgcacggtcgacgtcgacgcggggccgcgggcggtcaccgtccgggtcgccgacgacggcggattcgggctgcgcgggatgcgcgagcgggtcaccgcgtacggcggcacgctggccgccgggccgcagcccgacggcgggttcgcggtgaccgcacacatcccgtacgacgacgagacaccgtgaccgagccgatccgggtcctgatcgccgacgaccagaccctgctgcgcgacagcttccgggtgctgctcgacagcacacccggattcaccgtgaccggcgaggccgccaccgggcgcgacgccgcccggctagcgctcgcccaccggccggacgtggtactgatggacgtgcgcatgccggacctgaccggcatcgaggccaccgagctgatctgccggcagaccgacgacgtgcgggtgctgatcctgaccacgttcgacctcgacgagtacgtgtacggcgcgttgcgcgccggcgccagcggcttcctgctcaaggacaccaccgcggccggcctgatcgccgcgatccgggtcgtcgccgccggggaggcgctgctcgccccgacggtgacccgccggctgatcgccgcgttcaccgcggcgccgccgcgcccggcacccgccgtcgcggcgcacctgaccgcccgcgagcaacaggtactgctgctgatcgcccgcggccggtccaacacggagatcgccgggcagctgcggctgagcgtgccgaccgtcaagacgcacgtcggccggctgctcaccaagctcgccgcccgcgaccgggcgcaactggtcgtcgccgcctacgaatccggcctggtcaccgcggcgatcgcggattcccgggtgtcgccgaagtagagcggcacgaaccggccggccgcgtcgcgcccgcaacgcaccaggaccccggcgaccaggccgccgcgcggcggatcccaggtgaccagcggcgagaaccgggcctcggccccggacgcggcgaccccgtcggcgatcttctccgcggccgccgtctccggcgccggctgatccgacatccagccgaacacccgaccggcgcgcacctccgcgccgtcgcgggtcgcgcaccacagcgggtaactctgcgctatcacgctcacccgcccattctggcgccccggctcaccgcgccgggcggctgatcgcattctccaccagatcgaccgtggcccgcgggtcgtcgacctcgacgaccagccgcgcgtacgtctcgtcgcgcaacgcgatgaccacagcccggttcgggtcgctgacatcccagaagatccgctcgccggcgtggtggaacgagccggcggtcagcaccccgggaaggtgggtgccgccggtgcggatccccttccacccgcgggtgatacccgggtcgatggtggcgccggcgacattggccagcggaatctccagccggctgcgcagcgcccacaccttgtgcagaccgaggacctcgacatgcagggtgtcaccgacaacgctgatcttggcggccatctgccgcctccttcccgagggggttgatccgggcgcacagccgcagcccgagcagggtggccgcctgaccgcccagggcggtgtccaggtcggcgagcgccgcggcgacctccgcggcgacctccggatcctgcggggcacgttccgcggcggccagcagcagcagatcgagcaccgggtcggcggcaagatcggtcagcgaccccggccccgcgtgccgcagcagcggcccgacctcgtgctgcaggctccagcgcagcgcccgcaggtagagcccgcgtttactgccgaacacctggtagagactgttgcggtggacgcccaggtgggcgaccaggtcgtcgaccgagacgccgtcgaacgcgcgccgggcgaacagcccggccgcggcccgcacgacctcggtctcgtcgaacgctcgcggccttcccatgggcacgacgctacgccgtttaggaacgaccagtcaagaacgatcgttcctcaacgctgcgatgcgccgtagcagccagctcaccgaaccacccgatcacccgacgggcaccccgcgaccgtcaccaccacacccagaaaccccgccggaaccgcagcgcacctcatgaccagccgtacaacacaatccccaccgccacccccgagccccgagatgttgatcaccgaaagacccgacaatcccggaccggttgtgccgccaccaccacgacagttaggttgtggaggccaactgcggcgacgtgagggaaaccggtgcaatcccggtgcggtcgcgccactgtgaactgccatcaacggcagtaagccaggacgctcacccgtccgcagctcgatgatcgggacgcgcaatcccgtaggaggacgacaccaccatgcccaaggcccagaccacccggcccctcgccatcccggcgatctccacccgcctgctgctcaccgccgccggcatcaccctcctgctgctcgccctcgcctacctggtcgccttcgaccagggcgccctctcccgcagcggcatgtacatgcacgaactcatgcacgacggccggcacctgctgggcgtcccgtgccactgaggcccaccttcgggcggctcctcatcgccggcctcctggccggcctcatcgcgggcatactcgccggcaccttcgcctacttcgccggcgagccccgcgtcgacgccgccatcgccatcgagcagcagaacgccctggcccacggcgaagccggcggcggcgaggaactcgtcagccgcgacacccagaaacacgtcggcctgttcctcgccaccggcctctacggcatcgccatgggcggcttcctcgccaccgcctacaccctgctccgccgacgcctgcacaccaccagcgacacccgcgccgcgatcggcctcgccgccgccgccctcaccggcatcgtcctggtcccctggctcaaatacccacccaacccaccggccgtcggcgaccccgccaccatcaaccaacgcaccaccagctacctcgccgtcctcgcactcggcctggtcgccatctgggccggcatcatcgccgcccgcacccaacccaccgaatggcgccgcgccaccgccgcactcctcggcttcctgaccgtcgtcaccatcgcctacaccctgctgcccacggtcaacgaagtccccgccaccttccccgccgtcctgctgtggaaattccggctcgcctccctcggcacccagaccatcctctggaccgtcctcggcatcgccttcgccgcccaactccaccgcatcgccaccagcaccaccccggcccaaccggccacaccacaaaccaccaccgcctgaccgcaccaccgccgagaccgctgcgcgccccaggcccgcagcggtccttcgcataccgcctgcgtacgccaccagcacccgcgacatcgttcatcgcaggcccaggtcgcccaggacgcggtcgctgagccgaacagggttggcactcgtcgcgcgaaccctgccatccacgacgcggtaatagccctgggtcgtgctgaccaggttccaccgcctggcgccccgggcctgcagcaccacgcactcgccgccagggtgcaggccggcctgcccgggtccgtcgccgatcagtaatgggtgccggggcctccggacgcgacaccgcagttgcggcaaactctccacaggtcccagtcctcccgaccgcagaccaggcaccctccggcccggtcggcaccggcggcgcacgcatcgagcacccggtccaccacaaccggcagcggctcggccggatgcttccgcggatcgggacagtaggcgatgtcgtggcaaccccatgagtcccacggatgcagcgccgccgggacacgtctgccctcccgcttctgcaggcgtcgccgggcagcgaaggcgaccaccctcggcagcaccagagcgcgggccgcctccacctcgtcgagggcccggaccagcgacgacggatcggcctcgatacgccccggaatgcggtgcgtggtcgccagatgatgccaagtggcgtggaaaccatacggcgcgaaatggtagaggcagttccgcagacgcactcgccgtcgtcgggggtcgaggctctcgtcacgaacccggcgcgcggtcgcgggaaaactggtcaccccagaatgatcacagagccggcctgctgaccatcgatgccggttccttcaccgagcaggcaaaccccacgcgcaccgcaccgacaccgaaagccaccgccggtcgagggccacccggacgaccccggctcctctagggtgtcgccatgccccgattcaccggactcgacgacctcctcagccgcgaagaactgggcaccaccgcctggcacctgatcgaccagccccgcatcaccggcttcgccgacatcaccggcgaccaccagtggatccacaccgaccccgcccgcgcccgccgcgagggcccgttcggcaccaccatcgcccacggcgcgctcaccctctccctgtgcatgaccttcctgaccgagatcgtccaggtcgacaacgtcaccttcgtcgtcaacggcggcttcgaccgcgtccgcttccacaccccggtccgcgccggcgcccgcctgcgaggcagcatccgcctcctccagtcccgacgcctgcccaacggcgcccgcctggtcctgcgcaccaccgccgaaatcgacggcgaacctcgccccgcctgcgtagccgaccagatcctcgccctctacgaagcacctccggcccggtaaccacccaccgggtcctcggaaccgtctgcggtggcaccccgcccgggctcgaaagccgggccaccacgacctcgtgtcggacaggccgctccgagccgcaaccgctttcggcgcgagctgccaccgtcgtacgcgccaatcggcttttgatcttttctgtgcggtcggcggagccgtccttttggagtttggtgcgacttgtcgcaccgcctctaaggcatcctaggaagataggaaacggcctcccgtagcgtccggagcgtgaccgatgtgatgacctggcacccggtgaccgagaacgactgatctcctgctccagcgctggctgaacgccccgcacgtgcaccgctggtggttccacgaggccgccgcggaggcgatcgaccgcggcttggggcccggctcggaaccgaacgaggatcgttccgtggcgcagccgggtcgaccgtttccccgcaggtcaagccggccggcgcgctgacccctcggcgcgcaacgccgatggcaccaccacagcagtgtcatccgacgtagccctctggcgtgtccgcatcgccccgagggactgtgccacgagcggcttttctggctcgattcgcgggttttggttcggcgggatgggcacggtgagtaaaagaccgcagagatcgtggagccgtcgaagagggccgtggtcaaaggccgtgggctgtcgcctgagcagtccgcggcggctgcgacggtggccgaggcccggcagcgaggctgagagctgaccggcccgaacgggctgttgaagctgttcaccaagaatgttctcgagacggcgctgaacgaggtgatgacggagcacctcggtcatgggccgccctactggtgagagcgcctattcaactgtcgcctattctcgacgttgagccccccgccgattacttccgtatgcgggcacctggggccgaatcaggcgcgtgcagggcaggcgttcgcagcatcgagtctcctggtcggcactcaggcgaaggcgtccaagagcgtgctgatctgcaaccgcaacgccggcgagtgcgcgccggcgacaatgacagagaccatgtcaccgtggggtgccaggcggacgtcgagcgtctcgaagatcccgtccatggtgtatgagtgccagctgcccctgccttcgtccttgctgttgtccattgccctggccaccacctcgcgagctttgccggtggggcggtgcagggcgtactcggagagcaggtcgaggaaggcaccaaggtgcggtagctggattcgcccgtctatctcggtgcccttcggcttcggcagccccgcctcctcctcggtgtcgtcgcgcggctgtaggccaccactgacggcgtgcttgtcgtcgaatccaagacgcacgtccgcccagaggtccagattgcggatcgagcgagcgggatcgtaggcagcggtgggcaactgcgggatgcgtttccggcccgtctcgtcgaggcggtaaggggcgtcgaacgcggaatgccagtgctcgacggccgatgcgaaccgctgctccgctgcgggaccgctgaggtctagataccggccgatgtcctcccaggaactgccgcgttcccgttcgtagatcaccgcagtgatgacgagccgatccgcatgactggccaccgccgccgcctcgctgacgcggccgccggcgccggagaactcgtcgtagcgggtgaccgccagactcgccgcagcattggacagaccgctggcctggtcggagaggaccagacgggcaagggcacggcgcgagaaatgggagcggtcgtcgtcgtacggcgttctggcgatcatcgacggagcgttgcacatcggcgccgcgagcaattgctggcccctcacgaagtggtttccagaccaaaaacaacggtgagtagttgatgtcggccctctcctggacgcctgtccccaatagctggcagtggccgcgcccaaagccgagcagccgacgaccgtccggcgatcccggtcgccgcaaccgttacaccgcccgctcgaccagcgcggccgggaaccgtacgccggtcagcttctcggataccgaccacaggcgcgccgccagttgctcgtcgcgagcgcgggcggagcggttgatcaattggggctcgccgatcatgtgggcgaagcggctcggcccggtgaagctgttgccgggcaggtcggcggctgcggcgtagaggaccggcagcgcaccctgctcggcactctggcccaaggtgcggacgatgaaccggctgaccgggccggcctcggtgtagatgtcggtacgcaccagcccggggtgcgcggccatggcccgcaccggcgagccggccgcgtccaggcgccgctgcagttccgcgatgaacagcatgttcgccagcttcgaccggttgtaggccggcgactgcctgtaggcgcggcgctcgtcgttcggatcgtccaggtccagacggcccatccgctcggcctgcgacgccaggctcaccacccgcccggtgacctgtggcaacagcaggttggtcagggcgaacggcccgagatggttggtgccgaactgcaattcgaacccatcgacggtacggcgtagctccggcgcggtgatcccggcgttgttgatcagcaggtcgatcggcccggaccagctgtcggcgaacgaccgtacggacgacaggtcggccaggtcgaggcggcgcacctcgacgctgccgctgatggtgcgggcggcggcctcgcccttgcccatgtcacgcacggcgagcacgacccgggcgccggcgccggccagcgcccgggtggtggccaggccgacgccggagttggctccggtgacgatcgcgatccgcccggtcagatcgggaagggtgaatggggacatgggggcactcctccagtacgtgattgcactcagtggcatcacgatacgatgatgatgccactgagtgcaatcacgtaggctgtgccccatggcgagatgggtacccggcacggtcgagcgcctgcgcacggcggcgctgacgctcttcgacgagcagggcttcgagaagacgacggtcgcgcagatcaccgaacgggccgggatgaaccggcgcacgttcttccaccacttcgccgacaagcgcgaggtggtcttcgccggccaggaacactccgaggaactcatcgccgccgagatccgcggccaggaccacgggacggacccgcttcgcgccgcggtcgccgggctgcaggccgtctccgaccaggtctacgagcagttccgcgagggcgcggtcgtgctcggccgggtcatcgccgccagccccgaactgcaggaacgtgaactggtcaaacgcgccatcctggcggaccggatcgccgccgcgctgcgcgaccgcggcacggccgacgccgccgcgaccgtcgccgcctggaccgcggtggcgatctttttcgtggcccgcaatcagtggaaccagccggataaccagcacacgctggcccacctcatcgccatgagccgggaggacttcctgggcgccacccggcccacaccctagaagccgggtcgcgaccgtcggatccggcgcgcacaggccgggtccacgacgtgccgaagggttggtcgatggtgtctccgcacaacgaagctggcccggcggcagcggttgcgtaagagctgaccatcttccgcccggggccacgggagctgacaggcgcacaccgaagccgaccttgtcgcccgaggcctgccgtcgcggtgagggccacggcaatatcgggctgacccactttcaggtggggaatgcggcgaggagatggtctcggagcgctctgacggcgagcggtacgtgccgggcggaggggtaggccaggtacagggggaagccggctgtctcataggcgggcaagacggggatgagctcgccgctggcgacggcgtactcgccgacgagtcggggtagcagggcgatgccggcgccggcgacagcggctcgccggacgaaggacatgtcgttgacggtcagccttccgctcacggtgacgtcgaccccgtcgtcgccgtgcggatgacggtgcagctgccatcgggcctgtccgttgtgggcgcggaacaggatgcagctgtgctcggcgagctgctccaccgtggcggggatgccggtggggccggccaggtagccgggcgaggcgtagagccggaagctcatgtcctgcaacttgtcggtggtcaacccgtgctgggatggccgacccacccgcagggccaggtcgtagccggcttcgacaaggtcgggggtgtgcgcgagcaggtcgatgtcgacgcgtaccagcgggtgttgggcggtgaagctggtcagcaacgcgggcagcacctccgcgccgaggtccggcggcgcggtgaaccggatgacaccgcggggcacttcgcgggcgtcgacggccgcggtgacggcgtcgccgacctcggcgagggcggctgcgacgcgacggtggaaggcccggccggcgtcggtcaggctgaccgctcgggtgctgcggtgcagcagctgcgtgccgaggcgttgctcaagccgcttgacctggcggctgaccgacgacttcggtatgcgcagtacccgagccgcggcggtgaacccgccgcagtccacgacttggacgaaaaccgcgacgtcgtcgaggtcgagaccgcccggtgtgtgcggggcctgaccggcagcggtgtggtgcggcgaggtgggtcgaagggtcccgccggcgactgccggcttcgccgtgggctccagtgtcacggtgtgaagtgtccctgcgattgttccccgtgtgcaacaacgcgttcggatcttcgcgtctagtgcccatgctggcaacgcccgtaccgtcggcggcagcgggagagacccgccggcagcgcctccgaagggacccccgccgatgccccccaccgaatcaaccagcagcccgcttgcgactggccaccccgggccgcagcgtgcgccagaccggcctcctgtgctggtggcgctggccaccgccgtcgtccctgcgtatctgctcccggcggtgaccacggccgggaacgcgctggtgatccccgaccgtgcggtcgccacggcactggccacagccgcctggaccacgatcgctatcccgtcggccgtcgcgtcggcgctggtaacgctgtggacccgtgggcgcacaccgccccgacggccgacggccgcgcgcagcgcccgggcgttcaccctcgcggccctggcctgcacggtactcgcgggcgccggcagcgctgtcctcatcggcaacggtgtcctgccactgtccgcgctgcagtacaccctcacgtccgccgcgatcggcggcggtctggtcgccggccgatgggcccgcaccaaccggaccagccgccgcgccggacgtcggcgcgttgccgcgcgtcccgccagccgatgaccgcagtccatctcagctcgctgcgacggctcggcacaccctttcccgctggagccccgaccgggcaaccgcccccggtgtccggtcaccgcatcgccgacgacccgcacgctgtcaccgacgaaaggcaaccccatgatcctcgttctcggagccaccggactcgtcggcggcgccgtcctgcaccgcctggccgcactccaggcgcccgtacgcgccctggtccgacgccccacacccgccgtgatgtcgctgtccgcggccggcaccatcgacgtggtcgtcggcgacgtcgccgacgaggactgcctgcgccgcgccgtccacggcgtacggcaggtcttcctggtcatggccaacgggccgcagcagcagcaccacgaactcgccgtcgtccgcgccgccctggatgcccgggtcgagcacctggtcaaggtctccgcgccctacgtcggacccgaagtgcccgtcgccatcgcccgcatgcaccacaccatcgagcaagccatcgtcgccgcgggcgcacgccacgacatgcgacacacgttcctgcgcccgtacgcgttcatgcagaacctgctccacaacgctccgcccatccggatggccggcttcttcaccggcaccaccgcggacaccccgatgaacatggtcgacgtccgcgacatcgccgacgtcgccaccaccgccctcaccaccacccgcacccacggccgcgcgctggtcctcaccggacccagagccgtcagctaccccgacgtcgcgcggcacctgagcgcactcgggcgtcccacccgctacctcaccatgcgaccacccgagtacgccgcgaagctgcaccgcgccggcctgccaacctggaccatcgaacacctcctcgaaatccaggccatgaccctgacccaccccgaaacccccaccagcaccgtacgggacgtcaccggccacacaccgagaacgatcgaagccttcctcgccgagaacctcaccgagttcacccacccccgcggcctccgcgaacgactcatcgccgtccccctccggctggccacccgccgccacaccaccgcggcagcccccatcgcctgacgccatcaccaccggtggtctgggggagctgatacctggtcgaccctgaggaccaccgcggctgacgaccccgcccaccacatctaccgcagacggtcagctcggtcggcaacgagcggcccgcgcctccaggtggcgccgttcggccaggctcgccgtcgctttcgccgcacgccggtagaagtcgtacgccgcgccccgctcccccgccgcctccagcagatgcgcccgcaccgaccacaaccggtgatgcccggccagccgctcgtcggcgtccaggccggccagcagtgccagccccgcccgcggaccatcgatctcggccagcgcgatcgcccggttcagggtcaccatcgggttcggcgcgatccgctccaggatcaggtacagcgcgtggatctgccgccagtccgtctcccccgcggcagccgcgtccgcgtgcgtcgccgcgattgccgcctgcaactgatactgcccgagcgtcggcccgcccagcgccgccttcgccagcgacaacccttcccggatcagatcccggtcccagagtgaccgatcctgctcctgcaacggaatcagatcaccggcagcggtcgtccgtgcggtccgccgggcgtgcgtcagcaccatcagtgccagcagcccgctcacctccgcgtcgtcgggcaggtgggcgtgcaccagccgggccagccggatcgcctccccggccagatcggcccggtccagcgaccgccccgacgacgccgtgtacccctcgttgaagatcaggtagagcacgtgcagcaccaccggcaaccgctccggcgccgacggcagcggaaacgtgctgcccgccgcccggatccgctgtttcgcccggctgacccgcgccgccatcgtcgcctccggcaccaggaacgcccgcgcgatctcggctgtcgtcagcccgccgaccgcccgcaacgtcagcgccgtctgcgaggccgcggtcagcgccggatgacagcacaggaacagcaaaagcagcgtgtcgtcccgatccggcacctcctccggctgcacctcggcccgcgccgccacggccgattcccggtcccgccgcgccgagccgctacgcacctcgtcgaccagccggcgcgccgccaccgtcatcagccagcctcgcggatgggccggcaccccgtccaccggccactgcagcgccgccgccaggccggcctcctgcaccgcgtcctcacacccgtcgaactgcccgtaccgccgcaccagcgaaccgaggacttggggcatcaaccgccgcagcgtctcctcgacacccgtcggggcgggtgtcgcggccgcacccgggccggccgcggccgggacacccggcccgctcacgcctcgagcagcccgtccgcgaacatcacctgacgcacctcgaccgccagcccgtcgatcgccgcatccgggatccgcgccgccagctccaccgcccgcgcccggtccgcacagtcgaccaggtagaacccgcccaggaactccttcgcctcggcgaacggcccgtcggtcaccacggtctgcccgtcgcgcaccgacaccaccaccgcctgcgacggatccaccagcgcctgggtggtgatcagctccccggactccttgagcgtttccatgaaccgcccgtgcccgtcaccgatggcgcccttctcctcgtcggtcagggcctccagcacggccgggttgatgtagaggctgatcaggaacttcatcgtcgtaccccacagacttcgcccgggctcctctgggagccctctcgccgacaggtcggagccacggatcccaccttgacatcccccaccgacattttttgccgggcccgcctcggcaacaccccatcgcggtccgcaaggccgtcgaatcggttgggccgcacgcgctcatcgacgctgatcttcgcggccatgacaccggagacgtcccgcgtgggtcgcgccctatctgaccaggctcggcgtcggggcgccgaccttcgatacaacgcgcaggcggcactgtgcgcacgtcgagcgcatcgcctcggagaacatcggcagccagctcagacgcccccggggcatcagcccagaggaaccgcagccgactcgcatcacgaaccgatcccgttacggaaggacgtccacgtctaggacccttcagcttgcgcggcgggcgtcggtcgctcagcactcctgaccgaagatgcccctatcacctgggtgatgtcccactccggctagcgcatcctaggaagataggacaaacgcctcgggagaatccgcggcggtgaggcaccttgcggaagcaaccgtgacctgggatccgcacgacgccaccggggaccggattcgatccgcgcatggagccccgtcggcgatggccgtggctgctgtcgaacgccggaatcatgagcgtcaccgtgttcgtcgctgggctcgggatcaccgcgctggtgatcatgctgttgatcgcaggtggcgctgcggacgccggccaggcgaaactgcagattgaagcgctcaagtacgggctgggcttctctgccacggccggcgcggtcgccgcgctgctgctgggctctcatcgccaggtgctcgccgaacaccactgtcacggatgctgtggtgcccgtgtcgagccgcaccgcacctacaccgtcatcgcgcgccggtgtcggcgtcgtagcgacagagggctcaacagcagcgcaggcggggcggcgtcactgccgaggtcatccttctcaagccggtccgttcgggtggtcttcgcctgggccggcagcgcgtagcaggttgtcgtggatacgggcgagggcggctgcggcgtcggtgaggtccgcggctgcttgaggctgatcaccgggcgtaagggctgcagtacgcaggacatcttggagtgcggcgcgggcttgtagggcggcggcgagcagatggttgacgacgtcttgtcggtcgtagttcacggtggccgctgctggagagtgcatggcgtgtcctagtgggttcgttcgtctgtcccgggtttgctgcggcggtggcgttggtcttacaccgagcagcggggcgggacgatgtaccggctgttgccctgcgaggcgccggatgtgcaggctctctgcagccgtgggcgacgcggcgtggtcgtgatgctgagcacgggccgccgtcgctcagccggccgggtggggccgggtgcgatgttcggtcagcaggcgcatggcttcggtggcgccggtggtcaaggtggcgatgtcagcgtcggtgaaggtgcgggggacgacgtcgatgacgcagtgggcgccgaggacatggccgctgtcgtcggtgaggggtacgccggcgtagctgcggatcggggccatggcgaacagtgggttgtcggcgtggacggggtcgacggtgccgtcggcgatgcagtacggctcgccggccaggacggtgtggctgcacagtgcccattcggcgggggtgccctggacttcggccatccagccgggcacgccgtgctggccgatgatgaattgcgagctgtcgagcacgaccgaaaccatggacaccggagtacccagcagatcggcggtgcgagcggacagagcatcgagttgggcctgcagggtggagtcgaagacgtcgtatcgggcgatctgctggatacgggccggctggccgagtcggctgaacagttccgtggtggtgatggtgttcatgcggtgctcctggtcatggtgtgcgcggcggacaggtgggtgtgcgacgacaggcggatgttcagggcctgggcgcagagccggctgacgggatcgaggccggccatcgcggtgagcagccggtgcagggcatcgtcgccgctctcttcgcctgacatgccggcggcctgcagcagccgttcccaggtggagcggccggtgtggccgtgcacgcgcagcatcgcctcgcgggcgtcggccatggtcggccgttgcagcccgtaagagccgggcgccgtgtcgccggatgtgatcgacatgaatgcctcctggacgagcggggccgccgagccccgctccgggttggtggtgtgccgggtggcgccggtcagtggcggaaggcgctgaccagagtggtcaggtcgctggccaggcgggtcaggtcgccggaggcctgttgggtggccttggcgctttcggcggtggcgttggcgacctcggccaccccggacatggtgcgggcgacattcgcgctactggtcgcggcctcggccacggatcggctcatctcaccggtggtagcggtctgttcctccacggcggaggcgatggtggtggtgtagtcgccgatctgccggatcacgtcggtgatctccccgatcgcggtggcggcggtggtgctggagttctggatgttgctgatccggtgcgtgatctcctcggtggccttcgcggtctgctgggcgagttccttgacctccccggcgaccactgcgaagcccttgccgagttctccggcccgggcggcctcgatggtcgcgttgagggccagcaggttggtctgttcggcgatgctggtgatcagccggaccacatcaccgatctctgcactggcggcaccgagtgcggcgacctgattggtggtgcgttcggcgacggccatgccgttctgcgagacctgcgccgcggcgctggcgttcgacgcgatctcggtgatggaggcgctcatctcttcggcgccggcggcgatggactgcacgcctgcgttgacgttctcgctggcggtcgtcgccgtggtggcccggtgtgcagcgtctgccgcaccggtctggagctgggtgctgaccgcggtcagttcctccgacgcgccggccagggtcacggctgacccttcgatggtggtgaccgcctgccgtagggctccgaccgcggtgtccaacgcgcggcccatctgcccggtctcgtcgcgggaggtcatcccggtcgtgcgggtcaggtcgttgccggccagggcctcgcagacggccttgactttgttcaacgacctgacgatggaacgggccacgaacacacccagccccagggccagggccagccccgccaccaggagcaggatcgacacgatacggctggagtcgtaggcggactgtgccgtcccggcgttgcgggccgcgtcggcgtcctcggccccggtcagcgcggcgatgtccttgttcatctgggccatcagcggcaggacctgggtggtgcggatcgtctcccagccgacgatgtcgtcgcgttgcccggcgggcaggagcttggtctgcgcgatctgcacgtaggcctgccactgcgactccagatcggctatcagcgccggatcgccggcaggtctgctcgccttgtaagcggccagcgccgtggtgaaggcctgctggtccgcggagaacgcgtcggcgtacttctgggtgtcggcgggcttctgggcgatcagttggaaggcggtgtccagccgcgcctgcaccagcgtcttgtccaccgtaccgattgctttgaccgacgcgacgttactgcgatagatcagctgcgcggacccgctggcctttcccagtgcggacagccccagcaccccgatgagcaacgcgaccagcgcggcaagcgcgacagccatcagaatcttgacgttcacgctcaggtcggcgaacgatcgccgtccccgggccgtgggcgccaccggaacggcggcagcagtggtactcatggtgctctcctcggcgcgtgacagaaggactccgagccgttttccggcccagacatcccgcggtcagactccgccggccgctctacacctgatcggcaacccccggcaccggactgagccctcaccaggtacccgggataccgcgcaggtctcagcaccgctgagacgaaccgcaggtgaggcctggatcaactgcttgccgttgtggtccaggcaccggcccgttgcagcgctcggaccatgccggtgtccgctgtcctggtcaccggtgtccgcaaccgctccaactgcgggagccgggaaccgtccggaacgtcgagcagatcctgcaactgtcgggcctgcccggccgaaagcaacccgggctgtccccggtagtccacgcccgatcatcgatccaccgaacaagatccggctcggcgtcggcgaagtcggtgtacccgtactcccggacgatctcccactgatgctcgaaccgggtcagccggcgccgcagataccccttcaccaccgacgcatccgccgcgccgacctgcccggcgacgtggtcgaccggctcggtcggcacctgcagcggcttcccgttccgatctctttccagggccgcatcagtgcagccccgtgatgagctggcaattcctgaccctcgaccgacgaccccgcgcaccgcgacgagagccggcggtcgatcgagccgctgaggctacgggcggtcagaacccgcagaaggagtagtcgtaggggcgcccccgggcgtagacggctcgcaaccgcggctgcctgacctcgggcctgcgggccagaacgcggaggaagacccggccgtcgggctcgaaccggtgcgggaggcgcgccggcagggcctccggcgggatgagcaccgaccgcccgaccggcttcgggtcgcggtgcaccgcgaggtgccgccagacctcccaggccagcgggaccggcttcaccggtggggccaccggccagggttcgccggtctgcggatgctccgggatgagagcgaagtcgccggcggggtccggaaggccgggtcccgccaggaccagggtgccctcccgcccggtgccgggcgggccgacgagacggtcgagagtgggccggagaattccggcgacccggtgatcgtcgatcatcaccgggtcaccgcccgaggcggccaggaggtgcgccagcgctgagccggcggcggcctcccacatcgggtgccagccgccgtccgggtcgcacggcgggataccggactcctggccgagcaggcccgcccactcgcgcaccgggtgcgggccggggccgtcctcggtggtgcgggtggtcagcgggtccagccagaccgcctgcggcaggccgcagtcgtcgacccggcggcccaccggcgtgccgcaggtctcacagaccaggttcggttcgccaccgccgaggccgcaacaggcggcgtcgtcgaccagcgccaggtcgatgacggcgccgcggacgtcccccggggtgagcagcacctgaccggccggaccggcggagatgctgaacctcggcgcgtaccagccgagtgcctcggcctcaccgggctcacagtcgtcccaccgccgccacggcgatccggagggcaggggattcaccgcgaacgtgccgggctccagcgccggcgcgagcgatccctgcgcgttgccgtaactctgctccgcgtgggccggcagcgccaccctcgacaccggaaccgtcagagtggcgtcgcaggtccggcagccgaaaaccgtcacgcatcccccgtcgactgaagtcgatctaggctaccggtccgacggcgggaatgccgtcgaggagcaggaccacgccatgggtggcggcttcgcggtctcgggagatctcccggtactccggcgaggtggaccactgttcgaagtgttcgcgggtgtcgaaggacatcaggatggccttctcgtagggccattctccctcgaccacccgaggtgactcgtcggcggcgaggaggcggccgtggtaccgggtcaggacgggcatgaaggcggcggcgtaacggtcgtagcgctgccggtcgtggatggcgatctgggcgagtgcgaaaacggtcaccgcctcaggttactcatcggtagcttggcgtcaatggccgatcagcggccggcgggtggccgctgatcggcgcggggtcaagcggcgtcaacgggtggggtacaacccttcggacagttcgaccacctggtcgtgggtcagcgggatgtcctgcggatcccagccgacctcgatctgtgtgtcaccgccccactcgatgatcagggaggcggcgtcgggcaggtaggcgacgcggcggccgttcaccttccacgtgtcggtggcgccgtccgggtcgaaggcgccctgctgcatggtgacgcagaggccggtcgggttgcgctcgcgggcggccttgtccggtgtggccaggcacatctggtccgcgccgaggtactgcaggatcaggccgggcggggcgaacgggagactgaacggggtcggcacggccgggatgcgggcaccgccggtgaggtgctgggcgatggatcgcacggtgccgctgtcgcgcgggccccagctctgcacggtcacccaggtgccgtcggtccgctgccattggacgaagacgtacgtgtcgccatggcgggcgccgtcgtagtggccggtgacgtgcaggctggccgggcggtcctggatgaccgtcgtggtgctgtccggggtctcggtctccgggtccggtcggatcgggccctcctcgatggagagcacgtccgcgtcgcccgacgagttctcgagccgcaggttcgggccgagctgggtgacgaccgagccgtaggaggcgtcgatcccggccgggaggtagccgggccgcagcgggaacgtcggggcttcgtagaccgggcgggccggggtgaccgaggccgtggccgcggggccgggacggggggccgggtggtgccgctagctagctaggttccggtggatcccggcggtcaccgcggacagcaggtcggggtgcggggcggggcgctcggcgcggtcgagcaacgtcgtacgcaggtcgtcttcgaggttcacggttttgctccggccgtcgtcgggtgggcggggtccaggtcggtgcgcaacttggcgaggccgcgcgaggcgtgcacccgcacggtgcccggcgcgcagcggacgatctcggcgatctgctggtcgtcgaggtcctcgtaatagcgcagcaccagcacggcacgctgggtgcgggtcagctcggccagccgcgcccacatgtcgtcgcgcagcgcctgccggtcggcgaactcggcgccggccccggtcgccgcgcgatcgtcggcgatctccgccgggcgttcggtgttcgacaatcggcgcagccacgagatgtgggtgcggaccagggcggtccgcagatacctgtccggctgatcagtctcgattctcgaccagcggcggtacgccttgaccagcacctcctgcacgaggtcctcgccgtggtgccgatcgccgcagagcacgtaggcgaagcgccgtaacgcgtcgccccgggcccggacgtattcctcgaaaccactgtccactgatccccgccttttgtgccgtcacccttcctgacgcggtgagtgggccgcgctgcataccgcccggcagatgtcgggccgttccagcacgccggtactgtcgcagatctggtcgatcgagccgatcgccggccgcccgtccagcagagcctcggcgaaccggccggcgtcgatcaccggatagccgcggtcgaaatacggccgccggcgggtgtccaggggcgggcacaggccgagggcgttctgccgccgggccgcctcctcataggcgtcggcgagcgcgtcggaccgcgttttcgcatcgtccgccgccaatgccgcggcgagccgcggatcggggcacgccgccgacagccatttctgatagggcggccaccgtcgctgctgcagcagcaggagccgggcgacatcccgggccaggcgtgcggtcaccatgcgggatcccgggtcatcgccgatttccgcggtacgaccgacgaacgcctcttcctgcccgatgcgggcccactgacagcccagcacatggcgcaacaggtcgtccggataccacttccaggtcgcccggaccgccgccaactccccgccggggtcgtggaacaccgcgccgccggccacctcggcgagccgctgccacgggaggctcagccactgcgggtcggcaccgagccggtgccgcagccaggtttccagcggcagaatgtcgatgtagtggtcgaccgggccgtcggtgtcggccatcgaccggacccgggcgccgggcggcacgaagtgcgtcggccagccccggaaccgtttcggcagcccctcgcgcaggcgttggtcgaggtcgccgggatcgtcgagaaacaactgcaggcgcggaccccagtcgtggtcggtggagcgtgccgtgtcgaagccgaggacgtcactgcccgggccgatccgggccgcgaggtgcgggcggtcgtcgagcagtgggcggaccgcctcccggtagaagtcgcgggccagttcgacgccgcgccggaattcgggcatgaatccggtctaccatccggaactatgtggatcatcgggatttccgcgccgtgacggcattgacgcacagcaccgcgaacgaggtcaccggcggggtgtggcggattccgcaccagggcgggaccgcggtacggaaactggtgatgcgccgccgggcgggggccgcggcacatctggccgccagcgacgatcccggccatttcaactattggcggcgggagcccaccgcgtacgccgaggggctggcccggaccgcgttcaccgccggtggactgtcggttcccgaggtttaccggatcaccgaactggccgacgggtcggtggagatgctgctcgccgacgtgccgggccggccgatgcaggcatggcggccggacgatctcggggaactcgcctatcgcctcggcgtcgcgcagtgccggcggctggcggagatacccgcgtacgactggctggcccgggattttctgcgggactacacgctcgctcaacccgttccggaggaattggactgggatcacccggtggtgcgtgcggcgtgggatccggaattgcgggcgcggctgcgggagatgtgcgcggcccggcaggacctgctggcggccgccgaccggttgccgcgcaccctgtgccaccacgacgtgtggccgatgaacgtggtcctcgccgcctccgggccggtgctgctggactgggcgttcgtcgggccgggcgcgatcggcgaggacgcggcgaacctggccctcgacaccttcttcgacggcctgatcgacctgagcctgctcgacggggtcctggaagccgtcaccgacggctacgtgcgcggcatgaccgaggtggacccgctcgtcgtccagcgcgccatcatgatcaccggcgcggcgaagtacttctggctggccccgcgcatgatcgacatgctgatgcgcgaccagtcggccgcctacgaccggcgggactggccggaacgcttcgccggccgcgcgccgatcctggaggtggtcgcccgctgggccggcgaggcgctgcgctgaccggagttgatctcggctgccaggatgggccgcatgtcctatgacgacttcgccgaggcatacgcgtccgagacggagggcagcctcgagaacgcgtactacgcccgtcccgcgatcctcgacctggccgcagacgtgaccgggcggcgcatcctcgacgtcggctgcggcgccggcccgctcctcgaggcactgcgcgaccgcggcgccgacgtgaccgggatcgagcccagcgccggcatgctccacctggcccggcggcggctcggcgccggcgtcgccctgcaccggctcggcctgggcggcgatccgctgccgttccccgacgccacgttcgacgacgtcgtcgcctgcctggtgctgcactacctggaggactggacgggcccgctcgccgacctgcggcgcatcctcaaacccggcggccggctcatcgtggcggtcaaccatcccttcctctacaagctgatcaagcccgagggtgactacttcgccgtcgaggagtggtccgacgagttcatgttcagcggccgcaccaccgtgctcaccttctggcaccggccgctgcacgccatgttcaccgcgttcctcgcggccggtttccgggtcgcggtcgtcagtgaacccgcaccggctcccggcgcccgcgaagccttccccgacctgatcacctcgccgtcgggccgcttcatgggtttcctcttcctcgtcctcgatgcggcctaagtactgcaacggcactcagcaggcaccacgtattgatgatcggctcgttgggcgggtcatggtggacgtcgatgtgtcgggctggtcggcggagtaggaccggttgcatggccggttcgctcaccgtttacccggtctgagccacggcggcgggcccggcagtacctgtctgggctggccgccgggttggaccgcaagaatggctggactctggcggagcaggccggtgacatctcacccgacggcatgcaacggctgttggggtgggcggactgggacgtcgacaaggtccgtgacgacgtgcatgactacgttgtcgaacacctgcacgacccgcaagcggtgctgattatcgacgacaccgggttcctgaagaagggcgtgaagtctgccggcgtggcccggcagtattccggcaccgccggccggatcgagaactgccaggtcgggggtgttcctggcctaccgttcgagcaaaggtcacgcgctgatcgaccggcagctgtatctgcccgtggcgtggactgacgaccgtgaccgctgccaggccgccggtatcccggacgaggttgagttcgccaccagagtgcagatcgcccggaccatgctcggccggacgttcgccgcagggatccgggcgggctgggtgagcatggacgaggcctacggccagtcgaattcgcttcgggtctggctcgaaagccacgaccagccgtacgtggtagcgacccgccgcaacgacgacatgatcaccaccagcatggacaccgcccgcgccgacgagctgatcgccaccctgcccggccgggcctggtcccgcatctctgccggccttggtgctcacggcccccgcgaatacgactgggcccgggcgccagtgcggatttgctggcggcccggccgcgggcactggctcctcgcccgccgccatcgcaccacccggcgaactggcctactacgtctgttacggaccgcggaagaccggccgatggacctggcccgcagcgccggcggccgctgggctatcggcccgatctgcagtcgtcgccgcacccggccgatccatggacgtccctgcagcaggaagcggcccatcatgccactcggcggccccgccgggtcacaccggacggaccggaacgcccccggcgagcgagttgagcggggtccgtgaccgctgtggtccgcgctggacgcggtcgacgtgtggtccctgtcaaaaacctcatcgtcgggatacgacacctggccgacctcggcgcccaccaggatcatggcaccacggcacgctgcccgcatcaggacggatgatccccaagaagttagggctgcgagccggcccaaccgcggatgcgctgtagggcgcggtcggtgtggtccggtccgggtggaagatcttggactgtccaccggtgatgctcagcgagaattgcccgggtggtggagggtggatatgcgggcagcctcacgccgtagggggcgtgaggctgcctgctgccgattacttagctgatctggtcggagggttacggtgcccggtcgtcacggtcctcggcgtagggggtgtcgagggaagtcgccggactagctagctagccgatagcggacacagagtctggtgccgcaggtggttagatgccccgtctgcgcaggtggttcggctggtgccagggccccagggggcgtctcgatcgggttcgtccggttggggcctgcacccggctgtcttcacgatccctgctcgtgattgacgggggttagcgtcgatgccgaggtgatgcagatggcagccacggcgctacaggtcgaaaccgtcgctagtcggcgcggaattcgggtgcgcgtcgccggcgaactcgacctggcaactgccgggatactcggcgacgccctagccgaagcactgacggccgggaccggtcatatcgacctggatatggcggacgtgtcgtttctcgactgcgctggcctgcggatgctggagcgcgccgtcacagcgtcagacaagcggctgcgtctggtggcagccagtgcgactgtctgctggatgctgcgcatcgccggcatgtcggctttcacgaacatacccgctacgtcgactttgttgcaccgaagcgtgaccgccgccttgatcttcggtcccctctccgtacggcagcttgcccgatggcgcacgaaggaacggcggcatggtggggtcgccattcggtaaacccggctgccgttctgccggcgagtcgtcatcatgggcgcgtgctgaccctcgaagctcctctcgtcacgaagcgcctgcgcctacgtcccttccgctcccaagacgccgatgccctctacgacctccgctcgtgccctgaagtcctgcgctacctctactggccaccggcttcagtggaaggcgtacgcgaggtcgtcgcggcacggctcgccatgactaaattagccgccgacggggactgtctagtgctggccgtggaggtggcggccaccggcagcttcatcggggaggtggacctcagcctggtcagcaccgagcatcgtcacggcgagatcggcgtgatcctgcatccgagcgctcagggtcacgggtacgcgaccgaggcggtaggcgccctgctgaacttggccttcgacgtgttgaagctgcaccgggtgactgctcagaccagcgccggcaatcaggcggcggcgggggcgatgctacggctcggcatgcgtcaagaaggacacctgcgtcagtgcgtacgcttcgccggcgagtggtacgacgagctgatcttcgcgatccttgccgaggagtgggccaaccgaacgggctcagcgccatcgcacacggaaggcgggcacggctttattggacaccatggcttccacaacggtcacccataagcttgtattctaaccttcagcgcagcttgatcacctgtccgccggtaggcgattcgccggtgcgtggagcccgtgaccagggcagcattccgccgcgccgcctggcgcgctgttgattcgagcacccgcctggcgtcgaagtgagggcctcgccgaggtttagggacacgcgctggtcacgccctcgtagcgctggggttcctaacgtccgccgtcccctgagtaaggccgcgtctctccggtggcaccggtttctcgagcggcaccatacacgttgaaggtgacggtgcgttacagacactgcggagctacgccagctcgcacagcatccgcttctagccgacgagcggatacctgatcttgcaggcgccctccacagtgccattggcaaatagcctatgtgtggtgttccgtcgatggtctccgtccgccggtacagttgcgcaggtgacggacgagctgtgggacagctacgaccgggatccgagcggtcgcgctgcgtgctcgcgctctatgccgttcctagcggcgttcgcgcccaggcccgtgctgttctcacggccggaggcgggcttgatcgcgcttgcgcatggctcgcggccgcggaggccgcagacccgacctggcactacaagtcacacggctggacggcttccctgatcaacggcgctctgcagatagcagagacaactgaatgaccgcggtgccggccgcatctcgaaggcggctgcaatttcctctaccgctgcgtctagtcaagcgcagaaatggagggatccccatccggatttgctacgtccgcgcgtaaggcgtcggcaaataggtcacggactgtagtcatcggtccgtgaccggcacgagtcgatggggaggtcctgttcggtagtgtccgttcgtcgatctgctgacccatccgactgtcggagttgcggtgatgtggagacgccgagtgggcagcatgagggtcactcggccgatgtcgcgctgctgaagacgctggcggtgtcggtgaccatgctgacgctcacggccatcgggcagttggtcaccttgcctggggtgccggtgtactggcgcgccacaaacggcgatgcggtgttcacgacaagcggcccgacggcaccaccaacgcgcacatgacatgagcggaccgggatggcggctgcggactgccgggccgccgctaccggggaacgcagttcctcaggagtcgatatacgccgatagcattgccgcgtgaaatccgtactcggggccagaattcgcctcacccgccggtgcctggcagcagcagttgccgtttccgtcctactcgtcccggcccgggctgcccaggccacggagaccgccgcgactctcagcccgttcgccgccgacgtcacgctcacccgcgtgacgccggacacgaccagtctcatcagagccgtcgagaacgccggggtaaccaagggctcgatcagcgatgtgctggcgaccggccggaccggaaccccggggctgtgccacaccccgaacggtttgaacggcgccctcatccccgacggcttctgctgggacaaaaccgacgacgaatcgacctatggcgaaggcggcggcggctggatgccgcagggcttcaccaccgccgacggcgcctatgtgggccgctcactcacgatcacctcgtggtaccacggcacctacgttcgcgaccgcgagccgccggccattgaggactacgcccgtatctcgatcgccgagtcgactccgacccgggtccgctacgggcacgtggcgctggtcgaacccgcggccggtggcacgttcaagccgctcaccttccgcacccatgccgacggcatcgcgtggtacggcgaccggttgttcgtcgccaacggcgccgaacttcagatctacgatctgacccacctgtggcggatgaccgacactgccggcgacggcacgggcctcaccgcaggaaggtcgtcggcccgcggccacctgtgggcactgccgctggtggctcgctacagcaccgtcggcaccgcccaggtcgacaccgaatcttcggccttcgacaaggacaacccacgcgcctgcggtcccgcagtcgccaactacctgtgcctgagcagcctgagcctcgaccgcgccggcgtgacgccggccctcgtctcggcggagaaccggacgaagcccggcggccgggtcgtccgctggccgctgaccgctctcggcgcgggcacgcccagcacggtggcttcggagccggaggggtacatctcgccggtcggtggaatccaggggaccgccacggatggcacgagctactacatgagcggcacctgcccgctctcctatccgagcgccgacacgctctacgcctgcatcttcgtggccgcaccgggagagacgccacgtgtgttgacccaggcgccgcggctgaccgagggtctgtcctgggatccgcgcgctaagcggctgtggggcaccaacgaggcggtgccctcagccggccacgcgctccgcgtcgtgttctcactcaaccccggcgcgggtgcggccgtcgacggctggggctggctgaccaattaccacatggccggctcggcctgcgcgacgccggagggcaacgacacgggcctcggcaccaagattgctgtctggacctgtacgggttcggacctccagcggtggcggtacgacaacggcctcatcgtgcacaaggtcagcggtctgtgcctgacgcccgcgggcaacggcgcagatgcccagggcacggtactcaccttgtggacctgtgatggggccagcgacgtccagcgcttctccgccggcccggacggcagcctcgtgaacccgtggggaaagggcctcactccgagcggcaacgacgtcgagaagggaaggtacctgactctctggaccaaggggacaccgacacctgacgttcaagactgggtcatcaagggattctgagttcgtggaggccggacccacgtccggtctccaccgaactctgctcagcagaacccggtccacgggcccaccgtgttgacagggggtccgtaccaagatcggtgtctccgactattcggccggtagatttcagcggccgaacagccggtcaccgaaggtaacggcgaaggcgcacgttgccgcagcgcgcccgccggcccgccggatggcgccgcagacgacaacaccaagcccgcctcagccactacaaacgctgaggctacgcaccctgctgaatgccgttgcagtactagagcgccgatgcgggccgcaccgggacggggatcggcgtggctgccgtcgatgtgcgcggccgtgccgggcggctactacgatgtgctgatcgccgggttggccgccacggcgctggtcaccgctttctgggcgtacgccgtggtggcgcacgtccggcacacccgcaccgtgccgtggccgctgctgctgaccccgctgctgttcgccgccgtgtggctgctcgcctccggtgaccttcttcgccgtcaaggaccccgcgatggccaaggccgccgggctggcctggttccccggcatccgcccccggcccggcgacgaaggcgagtccttcgagccgatcgacggcgactggtacgcgtatgtgatccggcacgggctgtgacaggatcgcgaccacggtgccccgccgtggggcctgcagctgagcgagtgggaaggccgcaccgaggcatgaggcgattcttcttccccggcgagcgtgccggcctgacgaagcggccgtcccggctgaccggtttccgggcgctcctggccggcggcaccctgctgacggtgctgaccctgatcctgcagcccgccaccgaagtccgcggctgctcgaactacggcggcaacggcaacggcaccgccttcgccgacgagggctgggacctgacgtaccacgtgctgctgctcgtctggttgctcacggtcatcacggagcagctgctcccgatcacctggaacggccgcatggcgggaccggtcatcgcccgcggtgtcctcgccgtcaccctcaccctgatcgcctgctgcggcatcggcctcaagctactcatcctctgccattagccctcccctcacccagccccgctgatgaagcagaacggcgccctggcgagggtcctcgcccgcatgcgccatgaaggtcggcatggccgagggatcttcgatgggacgtggcggtaccgctgctgggcccgggcgacgtcgtcggcgcgagtgcagacgacgtcggatgagcgcccggtcgggttggcgctgcaagcacgccgagcacagtccgaggccggcgtgtcggcgcacctgcccgcactgacggcaggctcgcgccggttgcttcggcgggcggggggcgcgaacaggttccgcaccagtggctatttgctgaagaacctgcccaggtagcgggcggctgtgtggtcacctgattccgcggcgcgccggacttcttccactcgaccgtgctcgagcagcacggtcaggcggcgcgcatgggccagacgggcctggtccggatgctggtccgcccactcctggagagcagcaagcgcgtcgtccatgcgaccgcggtcgttgaggtggtgcacaagccacatgacgtcatggccggcagcgatctcgcggcggagttcgtcctcccggccctggcgggtcaatgcctccatgagcgtgacaccggcgcgatcgtcgcccgcttcctgcatcgcccgcaagtcgtcgagccggtcggcatcgaccaggatctcgaagagggtgacagcggcgcacctgtcgccggcaccggctcggcgccgcagctcggcttcgtcgccggccagacgaagcgcgcccatcgttcgatcgcacagccgatcggcgccctcatcttcgtggacggcataccggtgcgcggcgccgtagtaggaccaatcccgcaccgcggcatcatgccatgggacgcatgcccgggtgtccgctcgccgacaggctcgaacgcccgcacgtcggctccggatccggaggctgagcccaagccgggaaggcaacgcagcgtcatgccgacgccggcgctgaggtgaactccgaccactcgatccagggagcctgccggtctcgaccccggaaacggtggtcgtcagcggtgccgggcggccgcgtgcaggacctcggtgatcagcgtggcgatgtgcgggccggccagggcgtacacctgccgccggccctccctgcggacccggaccaggccggcgagacggagtttcgcgagatgctgggagaccgcgggccgggcggcgccggttgtggtggtgagcgcggagacgtcctgatcggtggggacgagggcggcgagcaggcgcagccgggtggggtcggcgagcagtccgagcatcgtcgttgccacggtgagggtgtcgcccgttaggtgtttctgcagctcactggcatctgcaacgttgtcgcgtgcgcgcatgagcacatattatgggtctcgcccacacggcgaccacgcacggggagttccgccgatgaccacatggcacgggatcaggcaccgcctcaccccgcattcgcacgccgccgcggaccgggtcgatgacgcgctggagtcgtcgcgggtcggcatgcgagccctgtggatctccctgggcgtgctcggcctgaccgctttcgcccaggcggtcatcgtgtggcgctccgggtcggcggcgctgctcggcgacaccctgcacaacgccgccgacgcgctcaccgccgtgccgctggggatcgccttctggctcggccggcgggccgccacccgggcgtacacctacggtttcggtcgcgccgaggacctggccgggatcgtgatcgtgctggtcgtcgccacttccgcggcgttttccgggattgtcgcggtacgccgtctggccgacccgcactctctcacccacctgccgtgggtggtcgcggccgggctggccgggttcgccggcaacgagctggtcgcgcggtaccggatcgcggtgggccggcggatcggctcggcggctctggtcgccgacggcctgcacgcccgcgccgacgggttcgcctcgctcgccgtggtgctcgccgccgggggtgcctggcgcggctgggcctgggccgatccggcggccgggctgctgatcacggtggcgatcgggctggtcctgcgggacgcggcgcgggaggtgtaccggcggctgatggatcgggtcgacccgcacctggtcgacgccgccgagcgggagctgcgccggatcccgggtgtgcggggcgtgtccgggatccggatgcgctggatcggacaccgcctgtacgccgaggcgtcggtgctggtcgacgcccatgtgagcctgatggcggcgcacgagatcgccgcggacgccgagcatcggctcacccaccaggtgccccggctgaccgaggcgagcgtgcacgtggacccggacacgcctcccggtgccgcgcatcacctgcggctctcccacgccgcgccaccggctacattcggatcgtgatcgacatcgcggtggccggccccgagcatcgtacgagaatcgtctccgccctggtcgcagcgttccgtggggatccggtgatccgctggcagttcccggacgacgacagctatccggagctggccgcggtcttcttcgggcacctgttcgacaagcgggtgcaccgcggcgcggtgtgggtggccgagggcggcaacgcggtcgcgatctgggagccgccggccgacgccagccccgcggtcgaggatgtgctgccccgcaagctgccggccgacgtgctggcccgggtgcgcgcctacgacgacgcggtgcacgcggcactgcccgccgagccgtactggtatctcggcgtgctgggtacccacccggaccacagcggccgccggctgggtcacgcggtgatggccgaggggctgcgggcggccgccgcggatgggcggccggcggttctggagaccgccaccgagggcaacgtgcggatgtacgaacgggccggctggcgggtgatcgccgagctcaccgacccgctgccggtgtgggtgctccagaacgacacctacgggtcatcccggatgtgatcaaacgcccacattcgggagggttcatctatgcgaatcctgcttcccgcagtcgcgctgttgctggtcgcggcctgcggcaccaccacgaccccgacgtcggcgccggccggggtgaacccgcacgccgggcacctggccggctccgcgccgccgtcgcaaccgctgcgcgccggtgaacggttcgtcgatctggccctcccgcaggcgtacaccccgaaggctccgaacggcggcaccgacgaataccggtgcttcctggtcgacccgggcctgaccgggaacgcctacctgaccggcagccgcttcctgccgcagaacgcggccatcgtgcaccacgcgatcttctaccgtctcgacccgcagcaggccaccgaggccgcccggatcgacgcgcagaccccgggtgagggctggacgtgcttcggtgactccggcgtcgagggccagaccgcgtgggtcgcgcactgggcgccgggcgccggtgagacgcagatgccggccggcttcggtttcgccatgccgccgggcggcaaactggtcatgcaggtgcactacaacctgctggagccgggcgcggccgggcagagcgaccagtccggcatccggctgcgggtcgccgccggcgccaccccgctcaagccgctgtccaccgatctgttcccggccccgatcgagctgccgtgcgcggccggcgagtccggaccgctctgcgatcgcgccgccgcgatcgccgacgtcggttcccgcttcggtgccgacgccggcgagcaggagggccacctcgtcgaacgatgcgacgccggcaaggtcaccccgggcaccacccagcactgcgaccggccgatcgaggagcccgccacggtgtacctggccgccggccacatgcacctgctcggccgctccatcacaatcgagctgaacccgggccggcccggcgcccggaccatcctggacgtcccgcagtacaacttcgacaatcaggccctggtcaccctgccgaagccgatcccggtcaagcgcggcgacgtcgtacgggtcacctgctcccacgacgccaaactgcgccggctcctcccccaactgcacaccgtcgccccgcggtacgtcgtatggggcgaaggcaccagcgacgagatgtgcctcggcatcctcgtcaccggccccgcgtcctgaccgggcgccgccggccgcctcgcgatcaggcggccggccacccgatcgggtgacagccgttcgtcggccactccgaacccggcacagggcatctggcctcgcgacaagcgctcgccgcgccgtcccgcccggccgccgggcaccgcggtttccggatcaaccggccgcgcggggtacccgccagggttgctgtatgactatagtcccacgcatgaagaccacacggccccgattgatgggcaccactgaaatctgcgtccggctgggcgacctgagtcgccagcgggtcaaccagctctccgccaagacgaacttcccgaagccgatcgccgacctggcccagggccgcgtctggctcgccgacgagatcgaggagtggatcgcccgccaccgcaccaccccgatgcccccgcaccacgacgcctgacccggtacaccgcacgccgccccggaccattcgacggaccccactccacgcacgtgtcccggacggcatgcaggacccctccccccgctgagcgacgcgccctcccggaggtgcacatcccggaggccgcgcccgacgcggatcaccacggccccgcacgcgccagggcgacccccggaatcagggaccgggggcagcctcgggagtcacccggccggaatggacgccgcggtcggagaccggagccggccaccggaaccaggcgaccgggatggacgcccgagtcagggaccggaggcgccccggaatcaggcggccagggcggacgtcggggtgaggcgggccgcgcgcatcgccgggtagacgcccgccaccaccccggccagcaacgcgccaccgagcccggcggcgacgctccccggcgggatcaccggcggccagcgctgccaggtcgcgtatccgatggtcgcggccacgccgatcgccgtcccggcacccccgcccagcccggcgagcagcaccgactcggtcaggaactggagccggatgtgcccgcggggcgcgccgagcgcacggcgcagcccaatctcgcggcggcgttcgagcaccgagatgaccatggtgttggccacccccaccccgccgaccagcagcgacactccggccaggccgagcagcagcgcaccgaaggcgctgtccgcggcccgcttcgcggacagcgcgtcggagggccgggacacccggaccagtccgggcagctgcgggctgacggtcgccggcagcaccgcccggacctgctcgatggccgcctcccggcagcggacgtagagcaccgtcggatgcccgtcgaagcccagcaaccggccggccaccgcccagccgaccagcaccgactggtccaggtccggggccagcggcaccggcgccaggatgccggtcacggcgaatcggcggttgccgacgctgacctgcggggccggaccgtccgggcggatctcgcccagtccgagccgggccgccgcctcggcgcccagcaccacggtcgggaaccgggacgtcgccgtggtgaggaaccgtccggatcggatcctcgcgttcaccgcggtgagcaggtcggtgcgggcggccagcacggtcagtccggatccgtcgtacgggtcgaccaggtccgagcggcgcaccacggcgtgcacgttagcgacggcgctgaccgcggtcaccggcccgatccgcgcggccatcgccaccgactccggcggcagcggcaccggccggtcgccggcgctctccggctggacccggagcaggttggtgccgagcgcagcgagccggtcggccaccgcctgtcggctggacgccgggatcccggtcaccaccagcatggtcgcgataccgatcgcgatgcccagcgcggagagcgcggcccgcagcttccgggtccgcaggccgaccacgccgagccgcagaacgtcacccggcagcatcgccccgcccatcccggagaccggcaccatcgatccgcgcctcccggagaccggcaccatcgatccgcgcgccccggaggactgcaccatcggtccgcgcggcgccgaagcccgcctccccggacccggtgtcctcgagccgtccgtcccggatggtgatgcgccgcggcagccgcgccgcgatctcccggtcgtgggtgatcaccgcgatcgtcgccccttccgcgttcagccggccgagcagttccagaacggcctcgccgttcgccgagtccagcgcaccggtcggctcgtcggcgagcaccagcgccggggcgttcaccaccgcccgggcgatcgccacccgctgcttctcgccaccggagagctgccccggccgatgcccgcggcggtggccgagccccacccggtcgagcgcctcctcggcaaggctccggcgtcgccgggccggcaccccggcgtgcagcaggccggtcgccacgttctccgccgcgctgatcccgtcgatcagatggaactgctggaagacgaatccgatccggcgcccgcgcagaccggcgagccgacggtcgccgagcgtggtgacgtcccggccctcaatcgccacggttccgctggtcggcaggtccagggtgcccatgatgtgcaggagggtggacttgccggagccggacggcccgacgatcgccgcgagctcgccgggggcgaggtcgagcgacacccggtcgagggcggtcaccccaccgggatagatccggctgatctcgcgcagcgacagcaccggtgccgtcacggggtgctcaccaccgtcaggccgtcggtgattccggggccactgacctgcaccaggccgccggagaagacgccggtggccgccgcgatcagggacccgtcggggcgttgcagggcgtagccgccctcggccagcgcgaccagggcgccgaccgggacggccagcacacccttgcgcaccagggtggtgatgcgcacctggacggcggccgcgtcgtacgcggaaatcggggtgtccggggtgaccgtgacgtcgaccttggcggcttccccaccctccccgccggtgaccgcccggccgatcgcggtgaccttggccggcgccgcggtgccggacggcgcgatcacggtgaccgcggtcccggtgcgcacggtggccacgtccgccgggctcatcggcacggagaccacggcgccggtcgcggtgaccgccagcaccggcccctcggccgggtccccggcctgcgcccgcacctcgctgacccggctcggcccgggcagcaccacgacgccgcccggggcgatgccggaacccggtaggtcgtcctccccgcgccaccgtttgatcgcggcgagcagtccggcgtcggccacctccgggtgcagcgaccgcgccgggtagccgagtgcggtcaggttctgccggacctcgagcacgtcccgcccgctcagcccgggcttgttcagcggccggaacagaggcgtgtcgccgtagatgacgatcaccggctggtcgtcgacccggtacagttcccggccccggatggtcttgcggccggtctccggcaggtgggtgatcacgccggtgccggggcccttgacgacgcgggccgggccgaagccgagcgtccccggcacggtgcgctcgtcggtgaggtccatcgtgcgcacctggatggtggtgacggccggtgcggcgggcggcctagctagctagcgagggtcgcgcccgccgcggtcaccgcgaccgcggcgaccgccccggtcgcccgcagcgcgcgactaggagccatggccgaacgcctccagcaggcagtcgtgctcgatctggctctcgttggccgggattccgccgtcggacgagtcgtaggtccactcgcccggcttggtcacgtgcaccttcagaccgtgcgcgcgcagacatttcacgtggtcgttccattgcgccgcgtatttcgggttggcgtcctcgtccagttcgggcggctgccgcggaagtctcccggcgcaggcggtgtacgcggacctgggctcgccgctctggtcgagccggcgccccgggccggccgggccgggctgatcgaccggatcggccttgaccccgtgggcgaccaggcagtcgtcgtaggcggtccagaaccggttcgcctcctcctcgctggtgtcgagtcgcagctgcggccgggaggcggcgggcgccgaggtggcggcggcgggcggggcgctctgcagggtggcgacccgaccaccaccatcggcggcggtgggatcgggagcgggcgcactgcacgcgccgagcgccagcagagcggtcagatagaggatcttcggcatggacaggactctggccggaacttgtcagagacctgttgtggtccggtagtggtccggttcccgggccgttgggtggcgcgcggccgcctacactcgccgccgtgtgcgcatacgtgctggtcgccgaggacgacccgaagcaggccgaactcgtgcggcgttacctggagcacgagggtcacgccgtcgtcgtggtcggtgacggccgggcggcgctggaggagatccggcagaacccgcccgacctggtggtgctcgacgtgatgatgccccgcgtcgacggcctggacgtgtgccggattttgcgccgcgactcggagctgccggtgctgatgctgaccgcgcgcaccaccgaggacgacctgttgctcgggctggacctgggcgccgacgactacatgaccaagccgtacagtccgcgcgagctggccgcccgggtgcgcacgctgctgcgccgcaaccggccggcggcccgggtcgcggatccggtgctgcgggtgggcaatctgcaggtcgatccggtacgccacgaggtgcgcgccgacggacgcccggtgacctgcaccccgggcgagttccacctgctgcggacgctggccgccgagccgggccgggtgttcacccgcgagacgctgctgcggcacctgcacggcttcgactcgtacgtcaccgcccgcaccgtcgacgtgcacgtgatgaacctgcgccgcaagatcgagccggatccgcgccgacccgcgcggctgctcaccgtctacggtgtcggctacaagctcgccgatggctagggcccgctccgccggccggggcagcctgctgggccggctgctggtgctgtccgcggtggtgtcgctgctgtcgatcggggcgaccgcctggctcgcggtccgcaccaccacccgcgcgatccagcgggagcagggccaggcgctcaccgacgacgcgaagatctacgacacgctgctcggctacgcggccacccatcgcgactggtccgcggtcgccccggtggtcgcgcagctggccgggagcacgggtcaccgggtcgtgctgaccgggcaggcccgggagccgatcgcggactcggcgtccggcccgctcccccagcagccgctgaccaccgtcgaccccaccgacgccggcaaccggatcgatccgcgggcggtcggcccgttccggctcaccaccgccgagcgggccggactgcgccagatcgccgcccgggtgcagagctgcctgcgggagccgagcaccccggcgccggcccgcgacggccagcagcgggtcctgccgcacaatgtggagatcgtcgacgagcccagcggccgcccgcggctcgaaacgcccggcagcgacctgagcgccgacacggtgacctgcatggaaggccgcaccgcgctggccgcgccgaccgccaccgaggccacagcgctgcagcagctcgatcggctggtcaactcctgcctggcccgccagcacctgccggccgtcacgatcggcctggagaacacctggacctgggccgacgcggagtcggcccgctccggtcggcgccgcaaccagccggtggccgactgcctcacggccggtcggcgcgagcagctggccggctgggtggcgccggccgcgctgctcttcgtcaccgcccccggggagcagagcgcgcggcgcgcgtccacgctggacctgtcgcgccccaaccagatccggatcggcgcggtgaccgggctcgtgctgctcgccgcgatcggggtgaccgcgctggtcggggtgcgcctggtccgcccgctgcgggcgctgaccgcggccgccggtcggatgcgcgacggcgacgcgaccgcccgggtccgggtcaccgggcgcgacgagatcgcccgcctggcgaccgccttcaacgacatggccgatcggcgacggcatgtcgagcagctgcggcacgcgatggtcggcgacatcgcgcacgagatgcgcaccccggtcacgaacatccgcggctggctggaagcggccgccgacggcgtcgtcccgctcgaccgcgagctgatggcctccctgctggaggaggcgatgctgctccagcacgtgatcgacgacctgcaggacctctccgcggcggacgccggcgagctgcgcctgcacccgcagctcgtggaggtggccgagctgctgcccgcgatcaccgacgccttcaccgccgccgcggaccgggccggcgtcaccctgcacacgacggcggcgtcggcgctggtcaccgtggatccgatccggatacgccaggccgtcggcaacctgatcaccaacgcgatccggcacaccccctccgggggcaggatcgacatcatctccggtacgagcgcgggccggctgcgcatcgacgtcaccgacaccggccccggcatcccgcccgagcagcaggccctcgtgttcgagcggttctggcgcgcggacaagtcccgcagccggcagaccggtggcagcggcctgggcctgtcgatcgtccgcaaactcgccgaggcgcacgcgggcacggtgacggtgaccagtccgcccggccagggtgccacgttccgcatcgacctgccggtcgccgggccccccggttcgcagcgcgccgggcgtggttcgatgggacggtgagcgggcctgggcagcggatcgcgtcgacgacctcgccgggcggcgcccggatcgggtatgcgaccgtcggcagcggaccgccgctggtgttcgtcaccgggtggctcagtcacctggagctgagctgggcgctgccggccgagcgtggcttcttccaggccctcgccgacgggcggcggctgatccgctacgacaagcccggctgcggcctgtccaccgcggccggcgacgggccgcacaccatggagcgggaggtggacgccctgcgggcggtggtcgacgcgaccgggctggagcgtttcgacctggtcgggatctccaccggggcggcggtcgccgcggcctgggcggcccgggagccgcggagcgtgtcgcggctggtgctctacggcggctggccgtacggtccggacgtggcgagcccggagatccgcacgcatgtgctcgggctgatccgggagcactgggggctggccagcgacctgctcggcggcgtcttcgccccggacgccgaccccggtacgagggccgcgttcgtgcgctaccagcgcgaggccgccacggcggaggtggcgggcgcgatgctgctcatggcgtaccggatagacgtccttgacctgctgccgtcgatctccgccccgaccttggtggtgcaccgcgaacgggaccgggccgccccgatcgagcagggccggcggctcgccgacggcattcccggagcccgcctggaggtggtgccgggacggtcgcacctgccgtacatcggggactaccggccgatcacccgcgccatccgccagttcctcggcctgcccgccgcccaccgtggcgccgcgccgggcctgaccgagcggcagcgcgaggtggccgcgctgatcgcgcagggccgcaccaaccgggagatcggcgagcggctcggcatcaccgaacgctccgcggaggcgcatgtggagcggatccgcacccggatggatttccggtcccgggcgcagatcgccgcctggtacgtggcgacggccggcccggcatgaccgggagcccggcagtgagcagcttcaaatccagggaccttgacgtgacagagcgcaccatcgggtgcgggtgtacctggcgtgactagctgtcagcggtgtccggggcatctgcaccggtcatcttgtgcgacacgctgttctcggtcggggtcagccggcgcgccgccagcctggaggagccgaccttcacccgtttgactctcgcgagatcacgacgtcaccgctccagttgtgccgctgcctgcaactcgccacgtacctggcgcaggtgcatgcgcatcgcatcggtggcggccatcgagtctcgggattcgacagcctccagcaggtgggtgtgccacatgatggcccgatcgaccccgccgggcacctgagtggccagcgtgcgggaacgccgccccagggtgaccagtgacgtgtgcatggcaatcagtagcggattgtgtgtcgcgtacgcgagcgcgctatggaatcggatgtccgcctcggcctgcgcctcgggttcgcgatccccgaaccgctgttgctccgccagcagagcacgtaatgtccggcgttcctcctcggtggcgcgctgcgcggccagtccggcgatgaccggctccagagactctcgcgcctcgatgaggtgggtcacgaccagctcgtgaaacatgtcggtgtcgacaccgcagcggaggtagtcgggatcgagctcattccactgctcacgcggggcgatcgtgctgccgctcccctgccgtacggagacgaaccctttaccggccaacttatggactgcctcgcggatggcgctgcggctcatgccgtaggcatcacacatctcgatctcggtgggcagcttgtcacccggccgtagatcaccagccgcgatccgctgcagatggtcgtcgaccacgatgtcggcaaggttcgccttggtcacgtgatctcccaccggtcgcttcctcgcctcggccggaactagctcggcatcgccaggatagcgatcgcccacagacgcctgcagccctggtcatagtcggcccgatgactcggccggccgccatcccggcatccggatcgatggcgtactcgtacttcaccgtgcatcagctccacggaccgctgcccctgcggaacggcggcgacaccccggcattgttctgctggtcgttcctggtgatagcggccggcgccggatcctggtccattgacgcatggctgtaccaccgctgggccgacatggcaccgcttcgcaactgaccaaaccgggcgccaccacctcacgcgccagccagtcggcatcgatgatcaccgctccgggttccgccagcgccccggctctgcacccccggctgcggccggggcgccgacgacgaggagagagacatgtcctctgatgaggccggcaagcaaggcgcgacgcctgatcgctccggcggttctaagctgggcgagctcagaccgcgccggcgacacgtgacgtttccctcaggcttgcggccgacaacactgagtaaccgccgtcgaccatcatctcggtgccggaaatgaacgacgcatcctcgctgcacaggaaaagcaccgctcgggcaacgtcgcagggctgaccggcccgaggcagaattcggtggacgccccacgcagattcccccgcgtcgccatcgccggggacgggccggaccccctccggtgctcccatccatcccgggctcaccaggttcactcgaatcccgcgaggagccaggtcgaacgcctgacagcgggtcatcgcgaagatggcgcccttggcggcgtcgtgaatccatcgaagcggttgagcctcgcgggccgcgatgctcgccgtatgcaccgccgccgacccaggcatcatgtgtggcacgcattcgccgagcaacatcgcggcgctgcgaacattcaccgccaaagctcggtcccattgttcgttggccgcatgggctccggccgccaccaagcccgccgtacagttgacgaggtacgagatggcgccccaaccggcggtgagatcgccgaccgcgcttcgcaccgcgtcgggatccgacacgtccacctcgatcgggcgaagcgctccctccacttcgtcggcgagcgcatcgacgaggcgaaacagcgcgggccggtcggcgtccagcagggccacatggcagccctgagccgcgaagtcacgggcaacggcggcaccgatgccggaagccgctccggtcaccacagcgacctgatcctgcatctcgggatagcgctgtatcgagttgaccatcaccacccgaaacccatttcgtgaatggcgacggtccggtcgccgacagcgatgcctcccatctggtcaccgaccatccttcacgcgacacgcccggcgggaaaccgggtgaagttcttcgggtcgtacagcggcaagatgatgtcggcggtccgccggacccgctcgtacgcggtcaacgcttcgtagatgttctcggtaatgccgatgggatggttctgctcgacgttctccaggtggaagaacgcgtcggagatggcgaccacgccgttggcggtgtccacctccaccaccatcgacgctcggtggtgtgcgccggcccaccaggtacgcaggccgggcgcgatgtgatcctcgtcggccagcaggcgtacccggggccatgcggttgtcaccagcggcaccaggatgtcgtcgggcagcgaggtggcgcggtcgtcgtgcgggtggtcgtgggtcctgtggaaatgtgaccagccacgctcactgatgcagatggccgcgttgttgaaggcgagcacgttgctcaccgaatacagttgcaggggcgtgaggatgacgtgggtgacctcctcagccgtcactccgacccgggcaagctgatctggcaggaattcgccctcggcacgccgcatcgcggcccgctcaccgagaaatgccgcccaacctcggttcatcggctcgagatcaagcgccgggccggtgttgaccagcgcgacgatcccctcaccacggatcaacaccacctgaaaggtcaagggatgccagcggtcccagtcgcgcatccagaacagctctggaccgggtatctcactgtgaccgacggcgagcgtggtcacctcgtaccggggcatgccgctcctcccgagatctgccgagggacatcagcggcgaagccaatgcgatcgacgcgccccgtcgggccgggttccgcgccaatctggcgcacgtacgtgcacgtcgcgtcagccgcggctggcgaatcgccgccggcgacggtgtccacaacgtggcggtgccaggcgaacgcacgatccaccgcgcccggcatcactgccgtcctcattccggatcgccggccgagaccggtgatcgaggcgtgaatggacaccaggatagggttgccggtcgcgtgcgccagcgcctcgtggaaggccatgtcggcctccgcatgccgactcggatcagctccattgagctgcgccgattctccggccagctccccgagtctccggagttcggcgggtgacgcgcggtccgcggccagcgccgcgatggccggctcgacgacctcccgcgcctccgccagataccggagtaggtcaccgtcatgtctcatggccagatactcggcgtccaactgattccagtcgctccgcggagcaacggtggatctgctgccctgccgcagcgtgacgaagcccttggcggcaagcgcttgcagtgcctcccgcaccgcgctgcggccgaacccgaagagtttgcacaattcggcctcggtcggcagcacggcaccttccttccattcacccgtggcgatccggtgaatgcactcgtcgacaaccatctggctgcgcttacgccggaccaccacgcatacccccgtcagaagtcaagatggccgataccggtgtcgtgtcccacgaggagtacaggcttgcccgcttcggcatcgtcctgccaagtgagcgcccgggagccgcttgggcagccctggccgcccgacgctggctccatggattcctccgtcccagcctcgcgtccacaagcacgatgggacgacgaaccaattttcataatatgtatgtcaagatcttgcccgcgaagccacctgatgtctaccagtgttcgcatatagatgttatgagagcgagaaggggcgggtcttcagccagcagcctgggcccgtgtttgcgacacccgcgaggtcgtgggcccgtagaagtcgccagtacgaacgcttgttgctccgtggtcggacgcggatcggcccgccgccgatgccggcgagggaacgcccctcgccggcatcgtggtcgtcaggcgtcgaagcgaacgttgcgcctacgacgcatcagcatcatcgtcacgccacccccgaggatcaggacagcacctacgatgccgaccagcatgacgggcgaaccggtcagcggcaggccggaacctccgccgcttggcgtcgcgggcgcagcgacaggggtgctcgcgtcgggcccatccggcttgcaagcgccgacccgggcgtaccggagcgaggcgcgcgccgtggagcggcgcgtcccgacgaggaggttcgcctcattgatcaccgcggtgacaccatccgaggcgcatgcggtgtccaccttggtgctcagacagacctgcgggtcgtccccacggaaggccagcgtcaccgcggccttgccggcctccacggcgtcgcccgtcggggcggtcagcacgacgtcggcggtcagtcgcgcggtcgcaccggtggccgggatggacgagaggtccagttcctgacccttcagcgcgatccggtcgaagccggccaccggctggttggtggcgtcacgaagggtgaccacggcgcttgcgtaccggctgggttcgatgcccgtaagggcaagggtggcccaacccttcacgtggccggtcttgttgtcacagtaataggaggcgggaacgatggcgggcaccgaggcgatcgcgacattgcagccggtgtggcccgcggcgtcgaacacctcgaagcgcccggagtcaccgaccgaccagaggcaaccgggagccgccgggtcctcgcgcagcgagtaggtccgggtggcgagcccggtgttcagcgccgcaacgccggcgcagggaccacctgtggcgaagtcgtagcacatgtaggtggacgtgtcgtcggagtgcaccatcggcaggtagatccgggcacccagccgttcaggcgatccgagaccgtcatagccgaggacgctggtgccggctgcggggaagcccgtaggcgtcgccacctgctcgccctggatgctgtagcaacgccagccgaccagccgatgattggcgctcagcgtccagcaggcgccggtcaccgcgccgccgtggtcgagcatcggcacgaagaacttcgacgcgtcgccggccgccggctcggacttcgggaagccgggacagaccgcgttcgtcgtggtgtcgaagcagaccaggtcgatacgaccggcgatatggaacgacgtgaagacgtagcggtcgtcaaaggcgtcggtttgcgcacgggcgccttcggtcgtgtcggtgttcgccgcggctgccgcgtcgacggtcaccgggaagcccgcgcacccggtgcccttcaccgagtcgaaacagaacagcttgccggtctcgttgcgcaggtagagacggcctcgcaccagagccgcgccgctcaggtcgattcccccgcggacgcggggcatcgcgtcaccggccagcacggtgaagccgcaggaacggttgctcaccaggtcgacgcaggcgactccgacggtgttgtggttgccgtccgcggcgccgcgctgcgccgggaagtagagccgcccgctggactggtcgacgacggtacccggtgatagcgcagtgtagtaatcgtctgcgccggtgttgatcgccttgccggcctctgacgagaagaaggtggtgctggtctcgtatcccgggcagaccgcgccggtggccttgtcatggcattccatcagcttggccccgggcgcacggtgatggtgcacggtgtagacgttcgacccgaagaaggccgcgtacgtgccgtcgccgccgccggagtttccgacgaagcccttgccggcgggcttgaccggcgcctcgctgccgttcgtgccggccggtaggaccgcaccggccacccggacactcttcaccgtggccggctgctccgacgcgtacgcgctgccgtccgcactgaaggcggtggtatagccggtcggcgcgcgcagggatcccggaacgaacgcctgccccgcctccaccggatcggtcacttgcgcggggactgcggcattcgttccgttgtgcaggccgatgacccagttgattcgctgaccggcagccacgtcgctgctcgatccggtctccgccactgtgcccgacttggtggccgagacgtcgcccggggcggcgcccgcggcgtacgggttcaccgtcagcgccgcagtggtcacggccagaacggcacccaggcgacggctaagtgatgtgatgaattgcgcgtccgaaggcgctttacccattggtaaggtttccttatcgtactgctgacggtcatacatgtgattactgaccagttgatcaaggaactggagcttgccatcgccggccatcgggcgcaagcggctgaggtgcccggcgcccgcgagtgccgaagatcatctgttcggtcaaacccgtccctgatgaggagaaggtgtgcggggcatcagtagggtggtggtggagattcgccggacgaagggtcgagaggtggggcgaccgaaagatcctcagcggcggcaggacgtggccgatgctgcgcgccgcgccgtcgttcgcgatgggctcacccaggtgcgcctacggtcgatcgccgatgaggccggcctcaccgcgggtgcggtgttgtactactacggcaacgtcgacgctctgctcatcgaggtgtatcaccagggcgtcgaacgctggtgtgtggagcgggaagcgctggtccgcagacacgacgacgcacggctgcgtctacgcgagtgcatcgagaccggcgttgccgacggcccggacgatgagctcggccggctgctgatggagttcacgccgcgggtgctgcacgacccgaccgcagcccggctcgacggggaattcgcgcagcgtcaggccgacatctacgcagaagtgctgaaccgcggcgtagaccaggggcatttccggctcagcgatgccgcggagctactcgccgccacgttcgtcgccatcgaggacggccgtcagctcgacgtgctcagcggtcgcatcagccggcaggagtcggtgcggaccctcgtgtcgtatgcccgggcagtgacctcctgccatatccccgacaccgtcggctgaccggccgatcggccggtcagccggtgagcgccggctccggtcgcgggcagccgatgaggtttgcacgaacccggcggcaatggaaagcacaccaatcgccaccgcgctcctgtctcactgcccatcctggggcgcgcgaactctgccctcacaccgcacatatttgccaggagaacggtgggcgcgaacgtcacggcgtcgcagcggtcctgcgcccggtggtgaggcggtcaccatccggcgcccgggacacatccgcgagtgggcacccattgtgatcaacatcgctgcaggaaacgtaggcggcctcggcgaacgtctacattgacatgaacagagcaacgaggcgcgtgctggccatcgctaccggcgccgcggctgtggtcggtgccgtcccaccgggcagcgccgccgcggccgacatccaggtcagttacatcgccaccatccgcgtcgacagcggccatggcgcggagtacttccaggcccgcttgaccgacccggccgacgtccgcgccgctacggacaatatgcagggcgtcaccaaccagcacatcaacgggcgggtcgtatacaccggtgcggacgtcaacaagggttacacctggcacctggacccggccgacgtcagcttcgtcgaccagtcgatggaactctgcgacggcgcgcccagctacgtcgccggcgacccgaacagctacacgcggtactgcccctggcacagcaaggttcaggacctccgcgtcacctacacgccgtaccgcccgcgaggctgacctgatcggcgccgcggtctcgctgcggggccaagcgggccggacggcgccgagtcccggcgggctcatctccgacccggaagtcgtgggccagccctgtaccttccgtcccgggacgcttgcggcaaagcgggtccaagatgtctgacaccgagccggcatgacacccgtccgggtcgtcttcgtctgccccgcacaagggtggagacgcgctccgccctctcggacgcttcagcgtccactgtcgttgtaagaccgtcaccagcacatcgcatggccgtggatcacgagtccacggcgtgagcaatccagcaggaggatcccttgcgcactacgaaaatcgctgtgtccgtcgccaccgttcttgccggtctcgccggcacggtgagcccggccgccgccgaacccgcagaaccggcacttgccgtcagtgacctcactgtcctcggtggcggcacccgcgacgcccgcggcaacactgtcggccgggacgtgtgcgggccgcgcggcaccgtcctgccccgacacgcactcggggacggttcgagcgcgtactacgcccacggcgacgccctgggcgcgggcctggacccggaccgggcagtcacgaccgacctgtggtgcacgttctccctgacggtcaccgccgcccagggccgggcgtacaacctgacgaacctatggatggccggccagagtcgtctggcagccggcacctccggcaccgcgactaccagcgtcagctcaccgagcggccacaccaacctcaccaccacgatcagcggccccaccacgctgggcgagaactggcagctgaacggcctgccgagcgacagggcgctgatcggcggttgcggcacggcggagaccctcgtcgtcacccagcggatgcacctcccgcgggagtcgaacggctacctgagcaacgtggcggaccccggctggaactccacccggctgatgctgtccagcgtgccctgtaacgactgaccccagaaaactgttcgcggttgcggcgtaccgcgccgccgcagccgcgaacagcccactgcccaagcgcctcacgggcaccagcccaaccgccagctggctgggcagcgatgccgacagatccgggccgatcgcttcccggacacttgatcagcccagcgtgcgcgaacaggccgatacacgctgggccgccgacgggctggggcgacggcggccaaccgcgttgacgcgtggttccgacagccggcgctggtagcgggcgtgcacccgccgcggtgtagtaccgcatccgaggcacgtcgcctgagccgtaccggcgtgacacggcagacgaccgccgcttggcgcggcttcgccatccgaggccacttcggatccggatccttaaacggcgtgatcgtcgagactttgtcggaccgcggccagcacctcagggtcctcacaaccgcgcgcatatccttcgatgcggcgccggatgtcatggcccagcagccacgtaccgatccgttcggcgacggggcgcaatatcgccgggcggcagcggaaatggtaccgccacgtcgccacggtgtgatcgggcagatccggggcgggcgcgaatcgccagccgcccgcgaacacgtcgaagaaccacggaccgcgcaccattttcatgccgacatggctcggcggggcgaaggacacgtactcgctgatcatgacgatgccgtgccgtgaacgcgtgaaggtgcgcacgcccttgccaggatcagtcgcgccatcgatgaagtgctgttcgcggacgaacggatcccagcggtaacgcaacggtgcggcggtctgggatacagcaaacgcgacgtccggggtcacggggacaacgatcacggcttccacgacaggcatgcggtcattatcggccgccggacctcagggcgctcagtgccgagcaaggcgtgagccgggtcatcttcgcagcggtcataggaagaagtcggcgacggtcggggcataggggatgtcgatgaggaatcgacgcggccggcccggcgggtggtagacggtcacggcggcgccggacgcggtccgcttcaggaaatcgtcacgggcggagccgaaaaaccggtaacgccgctgtcccccgtgttctgcggtggcctcatgccagtgcactgaaatcgtgtactggcagacatcggggccccgcgggttgaccgtctggaccagctcacggttggtcaccttcgccgtagcgcagacaccgtggcggcgcagcctgcgtagtcgtgcccggagccaccacatccgcgctcgacgacaggccatcaccgccgctatgccggaagtgacaccggccgcctcaaccagttcgtcggtgtggaacccggcgagtccggtcagcggtggggtctccagcagaagaccgacgccgatcatggaggccagcacggacgtcgcgaagaacgccagcatcacgacaccccacgcggcgctgatgccgaaacgcgtccaagccccggtccgccccttctccggcggcaccggctcgcggtggacgtggtacggcatgccgcccattgtctcgcatgggcgaggcggggagcggcgtgcggcaacaccggtcggtcgggtccgcgcaccgctatggcgccgcatgccgcacccgtttaacgcctgcctttggcccggagtccagcgtcagcagaaagagcccatgacgaccgcaagtggcgcaggtcgcggccaccactgccgacggcgccaaggccacccagcaggcagccaccgacctcaccgtgctcgccggggaactcacggccaccgtcaacagcttccgccactgatcgctccccatccggtggtgtgcagtcaacagatgagggccgaaacccgagcggcctgaccggggagcccagcatgcgccgatccggtttcaagccgatcagcgacaggtacgggccgccgcgatttgcaaccggctggcacttcgcaggcaggcctgaatgccgaacggtctgactgtgaagccaccacgagcagttgatgtcttgagcggagacacacagccgggtcgccaggcgggttcctggcggtcggcctgtcctgcccgactcggggtcaccgtttgcggtgtcgtgttggtctcttactgctggctactgatggcccagccgatgtccggccgcgcaatgatgatcatgagcaacctgatgatgatcggcgcggccgtgaccgccaccaccgttgcagcgctcgggttccgtcgcctgaccacatcctcgcggcggggtgccgccttgctgatcggctcgatggtcagtttcgccatcggccagaccatgtacttcagctatgaactgcacccagaacacggccagccgttcccggcaccggcggacgtcgcgtatgtatgctcctcgttgctcctcgttgccgccatagcgatccttgcgccacggcaacgccggcgtctccagactgcactcgatgccgccatgatcggttgcgctctgttgtacgtgagctgggcactggtgctcgggcccatcgtgcgcgggggcgctggatcggcgatggagtggaccctgctgctcctgtacccgatcgttgatctgatcaccggcagcatcgccttgctcgtcgtcgcacaggccggcacccaatatcgcggcccacggctgaccatcggattgggcgcgctcgccttggctgtcggagacagcggcttcgcgtacctggctcacctcggcctctacgtatccggcgaatcggtcaccgacgccggttgggtcatcggctatctggccatggggtggggtgtctggtacctcgccgcgatgcaggaacggcctgcgggccaagcccgcgcgcgttccgtagccagcgacgccggagccgcgaccgtgccgacgcgggcgacggtggttggtgtgaccacgccttacctgcctttcgcagcagcgctggtcaccacggtgttcctggtcgcccgggacggctccgtgcccaaggaactactactcctcggtctgggttttgcgctgctggtgatggttcggcaggtggtggcgttgtgggacaacattctgctggcgggaaagctccgcagtaccgtcgaacggctacagctgcgcgagcaggaactcgagatgctcgcgtttcacgactcgctgacggggctcgccaaccggacactgttccatgatcgagcgcggcacgcgctgatccggcaagaccggctcaagacctccctgtcggtgctttacatcgatctcgacggtttcaaggccgtcaacgatcggctgggccacgcggcgggcgacgctctgctggtgaccgttgccgagcgtctgcgctcctgcgtccgggcctctgacacactggcgcgccttggcggcgacgagttcgcggtgctcgccgatccgatgcaggctgtcgaggatgttgccgtcatcgcggaacgcatcgtgcggtgcctggccgcaccggtatcactgagcaacggtacagccatggttaccgccagcgttggcatcgccacccgcgaaccgttcagcggagacctcgacgcactgcttcggcgtgccgacgaggcgatgtaccaggcaaaggggggcggcaagaatcaagtcgtacaggcaagatgatgactcgctggcaatgacttccggcgatcgcgctgggtgacgtagctggccatcgtcgggcagtcctgtgcggcgaacaactgcccccgctcgttcccgcgtacttgccgcaggctgcgccggatcgggtgtgcaatcgtgaagcccttgctcggcatgtgtcgtggcccgaatggacccgtcggagataggcggcccggcatcgctgagcgatctcccatgccaggacgtgctggcggatagtccctgcgacggcttcgtcagcgcgaaattcgaacacgacatgctgccgctggcctttggccgctgggctgacgtcgtggactgttgccgtgaccgccacctcgccgggatcgagcgacgccgacaatgaaacttgatcaccagcccggagctgcaccgatgggttcaccaagcaggtgtgagatcggccagtctcgctcgctcgggagagaagggcacggcgaacgcctcgtagctgggccgagtagctgctcgatggggctcagctggcgtgggcatccgaacgcgcatcactcggtagatgcttcgggggctgtcggctccgccacgacgtgctcagcatcgccgtgctccagccgatgagtcagcgtgcctgcgaaacggatggggcgagcccagggaccagcttgggcttggttcgccggaatcggcctgctcgtggttatggcgtatccgttgctgcccggtgatggacttccgagatgttatttcgacgggattggcgtcggcggcaccgtagcggtgatccttggcatcctccgcaaccggcctcgagcggcgggaagctggtggctgcttgccgcgggccagctgggcaccgttgcgggcgacatcatgtacgactaccggcaagccgtgttgcacaacgcctcgtggcctggaccgcctgaagcgctgtacctgaccagcgaccttgccgtggcagccgggcttttcggcctgctgcgtaggcgccgccgcagcagtgatcacgccgcgttcgtcgactcggcgatcatcgcaagcgccttcgccctactcagctggatattcctcatcaagcccgcagccagggacgcctcgctgggtagatgggcgcaggcgatgatggtcgcctttcccacggtggatctgctgttgctggcgatggtggcgtgcctgctcaccgtgaacggtgctcgcaacaccgcattctttctgatcatcagtcggatagcagtcaccctcgttggcgactacacatggctcatcgccgaccggacctcctacgatcccggtgaggtcgccagccggctggtcgatatcggatttctgatcgcatacgtcacgctaggggcggcagcgctgcatccgaacatggtcgaggtcgggcagcccaccaccgctccgcgacgcccgacatcggcgatacggctggtgttcttggctgctgccgtcctgatagctcccgttctactggcatggcaggcgcgaacagcaagcggatatgtccccgacgcgaatgccatcgcttcgggcagcgctggtcttttcctcctcgtcgtcatccgcatggcgctcctgttgcagcaggtgcgcgcccagaaccacctggtggagcgacaagcccaacgactgcgggagctggctgaacgtgacgtgctgaccggcctgcccaaccgccgggcgtgggacgaggccctgcccgctgccctgaaccgggccgcccgcgatggcagcccggtcaccgtggcgattttggacgtcgatcatttcaaggcgttcaacgatacttacggccatccagcgggggaccggctgctgcgcgaggccgcagcttcctggagagcgaacctgcgtgaggccgatcttatcgcccgatacggcggtgaagaattcgttgcgttacttcccggcacgccgctcggcgaggccacgataacggtggataggctccgtccgactacgccgatggggtgcactttctccgctggtgtggccacctgggacggtcatgagagcgctgccgagctcgtcagccgtgcagaccgcgcgctttaccgggcaaagcacgccggtcgtgatcgcgtttaaagcgacatgcctccggaatccgtagccgcttgaactggctcctcgctgccgttatcgcggaattcctaataccggaacgaggcgacgagagtgtccaagtcagtggccaagtcaccgagctcacgagccgcttctcgcgtggacgtggcgtcgcgggtggtcgccgcggctatgtcggcgacgctggccacgttgtccgcgatgtgctgggagcccagtgccacctccgacacgctacggttgatctcgtcggtggtggccgactgttcttcgacggccgcggcgatattctcctgcagctccgcaatctgcatcacgacgtcagtgatgcggccgatcgccgctgtggcatgttccgtggttcgttgaatggcattgatttttgcgatgatgtcatcggaagcccgtgcggtttcctgcgcgagatccttcacctcgctggccaccacagcgaatcccttaccggcgtcgccggctcgtgcggactcgatggtcgcgttgagggcgagcagattcgtctgttcggcgaccgaagtgatcgtcgcgacgatcgcgccgatctccgcactggcggtgaccagttgggcaaccgactctgcggtttgctgcgcggacgtgaccgcttccgcagcgacgcccgcggcagaggtggtgctccgggagatttctgaaatggccgacaccatctcctgagccgcgccggccatggtctgcacgttgccggacacttcgtcggcagcaccggccacgaccgtggcctgggaactggtgtcgaacgcctgcgtgtccatgcgctgggcgacgtcggcgagtccccgggacgcggcggccagcgaggacgcccgctcgccgactcccgagaggatttgccgcatcgcgtcgccggcctcgttgaatgcctgcgccatgtcggtcagctcgtcgcggccgtcggttggcaagcgtggcgtgacgtcgcgtccggcgagaacacgcaaggctctggccactctggcggccggctggacaatgcttgccgtgagcagcaggccgagcagcacggtcagcaccagcgccagcccgcacccgatcaacaaggccgtccgcaggcgctgggccgccgcctgtgtctcacgctgcgcagcgtcgctgcgggcgatgactgagtcggccagcttgtcgatgttctcgcccaccgcctgaaacgtttcgtaggcgggcccgttcatcaggtccgccgtccgctgcggcgcgctccggccgccggtgcgcatgatggcgacgatctgattatcgaaactgaggaagtcggcaaaatgtttcttgaccgcgttcaaagaatcccgctcgccggcagctagatcagcaccctcgatcttggcgatttgccgcttcaccagctcgtacgcctccagcgtgcctttacggttgctcgactcagggtcggcggcggcttttccgccgatcagcgaggaatcccagccgaaacccagctgccaggcgctggcgtcggcgttcaagaacttcagctgcatgacgtcacgggtcagcacctgcagtcgccccacctcgtcggctacgtgtgtctgccgccgcgactccacgacccccaccgaggtcatcactgccaccagcaggcagaacagcccgaaggccagaaacagccggctacgcagtcggaggcgtcgcaagacaccgagcatgccagcctcccgtacgaaccgcgatcaccccgactttacgactccatgacggcgcattcgtcgcttcggctgaccaggccatccggtgtccgagaatcaagcggtgccggcgaactgcgaggtctggccgagcccttcggctgacagggccgagtagcccccgtccaccatcagctctgttccggtgatgaacgaggcgtcgtcactacagaggaagagcaccgcccgagccacctcatgtggttctcccaggcggcgcaggatgtggtaaggaccccataccggctcccaggcctcccggtcgtcctgggccgcccgcaagacctccggcgtccagatccagcccgggctcaccacgttcacccggatcccccgcggcgcgagatccagagcctggcaccgggtcatcgatacgatggcacctttggtcgcgttgtatgtccaccggtccggctgcgcaacatgtgcggagatgctggccgtgttcaccgcggcggagccgggcagcatgtatggcacacatgcagcgaggaccatcgctgtcccccggacattcacctgcaggacgcggtcccactgctcctgagtggcgtcgaccccggcggccacgaagctcaccgcgcagctggcgaggtaagaaatcccgccccatcccgcaaccagctcggcgagtgactccttcacggccgtggagtcggcgatgtccaccgtaatcggacggactgtgcccggcgctccggcggcgatgtcggccgcggtccggtgcagttgcgtctcattgatgtcgagcagggcgacccggcatccctgcgcggcgaagtcctgagcgatggcggcgccgatgccggatgccgctccggtgaccacggcgacctggtcgcgcatctcgggatagcgctgaacaacgttcactgtcgaagctgatcacattcatcatatgaatgtcaatcatggggttggcatcccgacgccgtttcaggaacaggatgagacttgcgggtggaagccggaagccgctccctgcgcgtccaccgggccgccggcttgcaggtcaccgcgcacctggcgcaggtgcatccgcatggcatcggtagccgccagcgcgtcgcgcgcctcaaccgcctcgacaagatgcgtgtgccaggcgatcgcccggtcgacaccgccaggcgtctgagccgcaagagtgcgagaacgacggcccagcgtgaccagtgaggcgtgcatagcgatgatcaacgggttgtgtgtggcgcgcgccagcgcgctgtggaaccggatgtccgcctcggcctgagcatcggcatcccggtcgccgagccactcctgctcaactagcagcgcgcgcaactcccggcgctggtcttcggaggcgcggatagccgccaggctcgccgtcaccggctccagcgcctgtcgagcctcaatgaggtgcacctcgaccagttcgcgcagcatgtcggtgtcgctgccgcagcgcacgaagtcgggatcgagctcattccattgttcgcgcggtccgatcgtcgtgccgctgccctggcgcaccgtgacgaatcccttgcccgcgagcttgtgcatggcttcccggaccgcgctgcggctcatcccgtaggcgtcgcacatctctggctcggtaggcaggcgatcccccggccgcaactctccgaccgcaatgcgacgcaggtggtcgtccaccacgatgtcggcaagattgaccttggccacgtcggactcctgccggtagctccgcgtaccgacttggcgccagtacgcggaacataataccaatttctctgaggtcgaaggttgtgccgtctccccttcagcaggcttgacggccggtcggccgaatcaccgtcttgacggtggcccgctcaccggatgccagttgccggaacgcttccggcgcctcgtccagaccgatctcccgatcgatgaacaggtcgaccggcacggtgccatcgagcaacgcctcagcggcttcgcggaaatgtgcctcgctgtagcagaacgatcccacgatccggcgctccgcggtggtgagggcatacgccggcaactgcacctgcggggagcccatccccacgatgcacaccgtgccccctggggtcaccatgtccagcgcggagtcgatcgtcgctgagatgccgatggcatcgaccactcgggcgatttcggtgaccccgcgagcctccaacgcttctcgcagggtggtggcgctgagggacaacccgaccgcgccgagccgctcggcacggcgtactttggtagcgtcgaggtctcccgtgaagacgtcgcgggcgccgtcacgccaggcggcccacgtcgcggcgaggccgatcattccggcgccgagaacagccacctcagtgtctctgcacacccctgcctgacgcactgcctgcagcccgacggcgagcggctcgatcagagcgccctgccagagacccgcttccaggggaacggcgttggcggccggcacgacgatctgctcggcgtaaccgccccggtagtgagagtcgacgccgatgacacgacgataggggcagaggttcgtattgccggcatggcatcggatgcactgacgacagccgatcaccgggttcaccgcaacgcaatcgcccgaggaccaccctgtcacgccgtctccgagctcgagcacggtcgccgagatctcgtgtcccatcaccatgccggcggtgcgccggcctgtctcgcccgcgtaaccgtgcacgtccgagccgcagatgccgactgcgtccactcgcagcaacaactcgcctgcggcagccaccggctccggtacgtcctccacgaccatgcgcatcgggccctggaagatcagcgctttcatgccacccgtccatccgggaagcgtgcaaagttcttggggtcgtacaacggaagcacgatggcagccgtacgccgcacacgctcgtggacggcgagcgcctcgtagatgttctcggtgattccgatcggatggtcctgttccacgttctccagatggaagtacgcgtcggagatcgccaccacaccactctcggtgtccacctccacgaccaccgacgcgcgatgatgcgccccggcccaccaggtacggatccctggcgcgacctcgtcctcgtcggccagcagccgaacccggggccaggccgttgtgaccaacggaacgaggatttcgtccggcagcgaggtgctccggtcgtcgtgcgggtgccggtgcgttgtgtggaagtgacgccagccccgttcgctgatgcagatgaccgcgttgtcgaaggcgaggacattgctcacggagtacagctgcaagggcgtgaggatgacgtgggtcacctcctccgatgacacgcagacccgagcgagctgatcaagaacaaactcgccctcctcccggcgcatcgccgcccgctcgcccagaaacgccgcccatccccggttcatcggctcgaggtcgcgggccgggccggtgttgaccagtgcggtcacgccgttcccgcggatcagcacagtttggaacgtcagcggatgccattgctcccagtcacgcatccagaacagctccggaccaggtatctggctgtgaccgacggcaagcgtgatcacctcgtaggtggacattgcgctcccttcaccttccccgagctgggcacctggtccggcatggcagcgccgactcggtggatctcggtgcgaacctgtcgcatatgcatcctcatcgcgtcgcggacggcgtccgggtcaccgccggccacggcgtccacgacgtgccgatgccagaacacggcgcgttccacggccccgggcaccgccgccgtggcgactctcgatcgccgtccgaggccggcgatcgaggcgtggatcgacacgagaaccgggttgccggtggctctggcaagcgcctcgtggaaagccatgtccaccgcggcgtgcctgccggggtctgcgccgcccacttgttcgagttcctcggccagttcccgcaaccgctgcacgtgcaccggtgaggcccggtacgcggcgatcgccgcgatcgccggctcgaggatctcgcgcgcttccacgaggtgactcagcaggtcgccgttgtggctgacgcgaaggtacgcagggtccagctggttccactcgacgcgcggcgcgaccgtgcagccacttccctgccgtaccttcacgaagcccttggccgccagcgcctgcagcgcctcacggacggcactgcgccccaccccgtacaaccggcacaactccgactctgtcggaagggtgtctccctccaccagttcccgtgcggcaatcctgcgcaggtagtcatcgacaaggacttcgctacgttttcgccggaccaccgcacgcccccgtcagaagttgaactggctgatgttggaaccgtcgaaggtcaccagcggacccgagatgacctgacccgccggcgtgatgctcatcgtccccaggctgccggcgctgaacgtggcgcccggctgggcggttatcgtgcccctcgccatgccggcgagcaggtagccggcgatgacgccttcccgcttgggatcccatagaccgaacttcttgaccgtcccgtcctggatgtacgccttcatcgaactcggcaggcccagaccggtcagcacgagcgtgcccttctgcggcgactcgctgatcactttggccgccgctggcaggcccacggcagtcggcgagatgatcgccgccaggtcagggtgtttggtcagcagcgcccgtgcctgcgtagtgctcttgtcgacctggtcgtcgccgtagacggtgtcgaccagctgcatcttggcgtactgcggatcgttcttcagctccttcttgagaccctcgatccaggcgttctggtccggtgcggtggaggttgcggacaggatggcgaacttgcccgtgtagttcatctgctgggcggcgaggtcgagcaggaacttgcccatcggcgagaagtcggtgggcatgatcgcggcatcgcgcccgtccgtggccttcatgtcggagttgatggtgatgaccttgacaccggccgccttcgccttctccaagctgggcagtagcgcttcgtcgtcgttgggcgagatggcgatcgcgctgaccttcttctggatcgccgcgtcgatgaacgggatttgcgctgtcggatcggggctggcgggaccggcttcctcgaactggtaaccgagcgtctgggacgtctccttgaagccggcgacaatcgcgtcgaagtacgggttgccgaggttcttcggtatgtagacgactttgaccggtccgcttgacgtcgtcgatccgctcttggcggaaggcgacttctgacaggcggttgccgacaccatcgtcgttacggccagcgctgtcagtaagaatcggggtatcgtgcgaatggacaacagttcctcctatggagttgcagctccgtacggaattcgtcgcgacgggtccaggtgcggacgccgtcgtgccctacgatcggcgacggcccaccgacgacggtcgccgtcgtgtgtggtggcgcaggcgcgcagcgagggaggccgtcatcgtcggtacgaggatcgatccgatgagcagaaggccgatgacggcgttctgcatctcgccgttgaccgaggcgacggtcatggcctgacgaacgacgacgatcgcgaagaacgccagcaatgtggcgagcatcgaaccccggccaccgaagatgtccgtgcctcccagaaccacaacggtgatgaccagcaattccatgccggtggcgaaattcgactgggcggaccccaggcgcgaggtgagcaaaatggcggccaggccgcagacggttcccgacagcgtgaatgccaccgtgcggaccatcgccgtgcggattcccgagtaccttgctgcctcggcattgctaccgatcaggtagcagagtcgcccgtataccgtgcgatgcagcaggaaccagaaggcggcggccgcgaccagcagcacgagcaccggcatcggtaagtccggcatggtgccgaaaacgccgtactggtcaaaacccacgaacgcttcgggaaagtcgccgatggacttgtcggtgagaacgacctcggccatgccctggtacagcgccaacgtgccgagtgtcaccaccagactgggcagtccgaagtaggtgatgatcaccccgttcacggcaccgagcagcgcgccggcgaggaccgccagcacacatgccagccaggtcggcactccggcttgatatgtctttgccagtgtcgcggcgctgagcgtcaccatcgaagcgaccgacaggtcgatgtcaccgttgatcacgatgagcgtcatcggcagcgcgacgaggcccatctcgacgtaagagctcgtgttggtcagtagtgccgcgggatcccagaaatcggctgacatgaggactccgaccagcaatgcggcgaccagcaatgcggcggcagtcgactccggagcgtgcagcaggcgctgccgccacgtctccgtagatgccgtcagcggctcgccggcatcggccgttaccgacggggagatcgtttcgctggtcatgccagtgcccttcctgacaggcgccgccgcttctcgtagttcatgcggatgcgcgcgtcgaagatgacggcggcgaggatgatggccccctgcgcggcgctctgccagaacggcgacacccccacgacggtgagaccgttgccgaggatgccgatcagcaggcaaccgagcaggctgcccaggatgctgccgctgccgccgaagatgttcgtaccgccgatgaccaccgcgctgatcactgcgaactccatgtgcaggcccgcgtcggcgggattgatgctggcgaatcgggcgacgtacatggcgccgccgagcccggcgagtgcgccggagatcacgaaaacgccgacggtcagccgtttgaccggaaggccccgcgcgacggcggcctcgggagacgaaccgacggcgtagaacctgcgtccggtcagcgtgtaccgggtgaggaagataccgaacaccagtgtggccgccgccgataccagcagccacggcacggcggtgtgcgctcctgaagccaggctcaccacgccgcgaggcagatcccagtcgttgacctgacggccaccggagatcagaaagatcacgccgcggaaggcggcgagggtacccagggtggcgatgatcgccggcactctgccgacgcttaccaccagcccgttgcacagaccagcggcggcgccgacgaggacggctaccagaaccgccatcggcacggagacgccgggatggtcgcggaccagcatcgccatcgccattgcgctcagtccgacgatggaccccacggagagatcgatgttgcgggtgacgatgacgagcatctggccgaccgccacaatcgtgatgatgccgatgtccagcagaatctggttgacattcgtcggagacagaaagcgtccctgcagaccaccgaacacagccgtcaacgccaggacgaaaacgccgataccgagatcacggaagagatagaggccgcgcccacgtggcatggagaatttcatgtgctcgcacccgccacgtccacgttgcgagtggccagtgcgacgatgcgttcatcggtcgcgtcggcgcggcccagttcgccggctagtcggccctcccggaccaccaggatgcggtcggccagcagacgcagttccttggtctcgctcgagatcaccacgatggcgattccccggtcggcgaggtcgagcacaatacggtggatggcggccttcgcgccgacgtcgacgccccgggtcggctcatcgacgatcaccacctgcggcccggtgagcaaccacttcgccaccgcgatcttctgctggttgccgccggagagcgaactcacgggttgctcggttgacgccgcgcgaactgcgtactgccggatcgcccccgccgcggtttcccgctcccggcgcccacgccggacgccgtgacgagccagcgacgacaagagccccaccgtggcgttctcccggatgctgcagcgcacggcgagaccatggcgtgcacggtcctccggcacgtagaccagtccggcgcgaaccgcctgagcggcgttgcgcggccgtgaccgcgaagtgcccacctccactgtgccgccttcgcgcgaccgaactccgaagatggcctcagcgatctctgtacggcccgcgccgaccagtccggccagtcccacgacctcccccgcgcgcacgtcgaagctgacctcccggaatgccccggcgctcgcaagatctcgcacccgcagcagtacgtcgccggtgggccttgcggcgggcgccgctgcctcctcgacggcccgcccggccatcgcccgcaccagggcgtcggcatccgtctcggcagcccggaccacggtgaccaactcgccgtcgcgcagcacggtgatccggtcagcgatctccatgatctcttcgaggcgatgaccgatgaacacgatcgctacaccccggtcgcgcagtccccgcagattgctgaagagccgggccacctccgcaggagtcagcgatgcggtgggctcatcgacgatcagcactttgggatctcggcgcagtgccgccgcgatgtcgaccatctgttggtcggcaacggatagatcacggaccttggcccggggggacacccggcagccgacccggtccagcagcttctgagtctcccggatcgcggcggcccagtcgatggttccccaacggcgcggcggacggtccaagtagatgttgcccaccacgtcgaggtcgccgaacaaccgtggctcctggtggatgatgttgacgccggctgcctgggcagcctgcacgttaccgggaggaagtgacactcccccgacgtcgaccgtgccggtgtccgacgccacgacgcccgccgcgatcttgacaagagtgctcttgccagcgccgttctcgcctagaaggacgtggatctcaccgggctcgacgacgaacgtgacatcggtcagcgcccgggcgccaccgtacgacttcgacaggccccggcaggccaaggctgcttccaccggatcgtcctccacctcatgccgtcgccgatgtgatggcggtgacgctcgcagttcataagatgtatgtcaagggtgttgccggttagctcgcgcgagccctaccgtatgggctcgatacatcacatcaattcgaggactgccatggctgacggaccacacattgtgatcacggactgtgacctgggagatacggacatcgaggaagagctcctgatctcaggtctcgacgcgcgggtgacggtcgctcggtgcaagagcgaggatgatgtcatcgacgcggccggcgacgctgacgctctgctcgtgcaatgggcgcccatcaccgcccgcgtcctcgaagcgcttccccacctcagggcgatcagccggtacggcatcggactggacatgatcgacctcgacgccgcccggactcgcggcatcgaggtggccaacgtgccgcactactgcaccgaggaggtcgcctcccacgcggcggccttactactcgcgctctggcggcgccttcccgcgctggaccgcagcgtccgggccgggcgatgggagccggtgccggtcatggccggcgtcaagccgctctcgtccgccactctcggcctgctcggcgccgggcgcatcgcgcaactgaccgcgcgtcccttcaccgccttgggtacacgagtcgtggcctacgacccgtacgccacagcaacgccgggtgtcatcgagctggtcggcctggacgaactcgccgacgctgacctgatcagcttgcacgctccgctcaacgcggagacccggcacctggtcgacgcggcattcctgagccggttgaagtcgcacgcggttctggtcaataccgcccgcggtgctctcgttgataccgcggcgctgatcgacgctcttcgcggcgaacgcatcgccggcgcgggcctcgacgtctacgagaccgagccgctgccggctcaccacgagttgacctcactggaacgagttctcatcaccccgcacgcggcctggtgctcgaccgacgcgctgccgacgttgcaacgacaagccgccgagaaccttctgcggcttctcgccccctccgcctgaccgccatccgagaaggagttccatgcgcatcgcgctgctggacaccgcctccgggcctcggctcgccgccgaatgcgacggcgcctacctgccgatggccggcaacgacctgcgagcaatgttgaccgcggatgccgatctgaccgatccggtactcggttcaccaccggtgaccggcagtcttcgcgccccgttacgacccggcaagatcgtcgcaatcggcctcaactatctcgaccacatccgcgagaccggcctcgacaagcccgttgagccgctcatcttcaccaagttcgtgtccagcgtggtgggccccacggatgacatcgtcgtggacccggcgctgaccgagcgcgtcgactgggaggtcgagctggccgcggtgatcggccgccgcgcgcgcaacgtcgacgttacccaggcactctcccacgtcgccggatacctggtcgccaacgacatctccgctcgggacctgcagttccgcgatggtcagtgggtgcgcggcaaaagcctcgacaccttctgcccgctcggcccggtcttcgtgaccgcggacgagattcccgatccgcagaggctctcgctacggacgatcgtcaacggcgagattgtccaggactccagcaccgaggagatgatcttctccgtggccgagttggtcgccttctgctcgcgaagcttcaccctcgatcccggcgatgtcatcctcaccggcacgccgtggggctgcggggagttcatgaacccgaagcggtcgctgcgcgagggcgacgtggtcgaggtgtcggtcgacggaatcggccggctgcgcaacacggtccgtcacgcctcctggtcactcagccgaaggaccgagccgtgcgaatagcgctcttcatcacctgcgtcaacgaactgctgcgaccacagaccgggcaagcagtcgtccgcgtgctgcgccggctcggtcacgctgtcgagtttcccatggcccagacctgctgcgggcagatgcaactcaactccggctatcccgatctggtcatgccgctcgtgcacgactatgtatcgactttcgaggagtacgacgcggtggtgaccccctcaggatcgtgtgccgccatggtgcgcgagcattacggcaggctcgacgcccgagccgcctcggtggccgcgcgtaccttcgagctttccgagctgttgctcgacgtgctgggcgtggaagatgtcggtggcaggttcgcgcatcgcgtctcctaccacccgacgtgtcacgggctgcgtatgctccggctcggcgaccgcccgctgcgcttgttgcgccgcgtgcgaggcctcgagctctgcgaaataccggaagcgacgcagtgctgtggcttcgggggcacgttctcgctgaagaacgccgcggtttcgggtgcgatgctcgccgacaaatgtgctgccgcggaaaccacgggcgctcactatctggccgctgccgacaattcctgcctggcccacatcggcggcggcctcagccggcgccgcagcggtctccagacgatccactatgccgagatcctggcggccgggcagtgagcggcctcggcataccgggaacggcccgaggcgtcccctttcccaccgccgcggcgcgggcactcgccgacgaacagctgcgggccaacctgcgccgagcgaccagcaccatccgccgtcgccgcgacgaggcagtcggtgagatcgccggctgggaacagctgcgcgacgccgcagcggccatcaaagccgagaccatggcccggctgccagaactgctggaacgattcgaggcggccgcgacagcagccggcgcccaggtgcactgggcacgtgacgcggtagaggccggcgccatcgttgccaggctggtggccgccgcaggagccagcgaggtcgtcaaggtcaaatcgatggcgactcaagaaatcgcgctgaatcacacgctcgcccgctcgggcgtcgacgtggtcgagaccgacctggcggagctcatcgtccagctcgccgacgacgttccttcacacattctcgtacccgcgatccattacaaccgcaagcagatccgcgacctgttccgcgatcggatgccggacgcgcccgctgatctcagcgacgatccgcatgcgttggcggcggccgcacgcgcacacctgcgcgcgcgttttctctccgcccaggtggcggtctcgggcgccaacttcgccatcgccgagtccggcaccctggtcgtggtggaaagtgagggcaacggccggatgtgcctcaccctgccgcgcaccttgatcagcgtggtagggattgagaaaatcattccgcgcttcaccgacctgtcgatattcctgcgccttctacctcgctcgtcgaccggtgaacgcatgaacccctacacctcgacgtggaccggcgtgactccggacgacggtccgcaacagcttcacatcgtcctgctcgacaacggccgctcagcaaccctggccgacccggtcggacgccaggcgctgcactgtatccggtgctcggcgtgcctgaacgtctgccccgtctacgaacgcacgggcggtcacgcgtacggcagcgtctacccggggccgatcggtgcggtcctcacgccacagctgaccggagtcgccgcgaacccgtcgctgccgttcgcctcgacgctgtgcggcgcgtgctacgacgtctgcccggtgaaaatagatattccccgcgtgctggtacacctgaggcaacaagcggtgctcgcctcaccggcggcacccgaaggcgccgtgatgcgggcattgacctggaccatgagcgatcgccgccggtacgaacgagccttacgggccgctcgcgccggcgccgctccgctggtgcggatactcggccgacgcacggtacgccggctaccggcaccactgtcgccctggacgcgctatcgcgacgccccgctgcccgcagccgaatccttccgggattggtggagacgcaatgacccacgcacgtgacgaaatcctgtcccgcctccggcgagccttgtcagactcgccggcggtgccgcaagctctcccgctgccgactccgacacaaccgccggacgctctcgctctgctttgcgaacggttgctcgactaccgggcgcaggtggtcaccaccacgtggcacctgctgcctgacatgctgaccgaactcgtcacgggcgtagcggacgacatcgccgtgcccgcggatctgccttcacgctggaccgcggcctggcaggcacgtgccgtcgtggaccggggccacctgagcaacgcggtgctggaccaggtgggtgctgtggtcaccggttgcgcgctcgcggtggccgagaccggcacgatcatccttgacgccggcccccgccaagggcgccgggtgctgaccctgcttccggatcggcacatctgcgtagtcgatgcccggcaagtagtcgcggacgtgcctgacacctttgcccggctggaccacagccgtccactcacctggatttccgggccctccgctaccagcgacatcgaactacgccgcgtggaaggcgttcacggtccccgtctgctgcaggtcgtactggtcagctgagcttgccgcatgcgcggcgagcggcaagcggcgcgacaaccagcccggcaaccaccactagacaccataacggccggcctggctcggaccttcaccacctcggagatctcatgaaccgacgccccaccacgacagcgccgacgcgggtcatggctcgcacgctgagcatcgtcgtcgccgtgctgggcgcggtgacgctaggcagccgcaccgcacggcccaggccagtgtcgccgtgaccatcgtgacgcactggaaagatcgcgactccttcgattgctacgcattcccgaggccacccaagcattcggcgggcccatccacgacgctcacgctcaccgatcacatgcgcactccaccgagccgggacgttgcaacctccggcgggtggactcactcgacacgagcgacctggtgcacccgaagagccgacactcaacggcgctcactcgaaggcaccggacggtgactgggtcactcaggccatcgagctgtgccggctcgtcgaacgcgggctgcacctgtatctgtggttcatcggcgaccgatccgctcggctgcggtgtggcgatgaccgccgggatccgccccggccgagcgggcccacggcggcggcccggctcgccggctgcggtattttccggcctgtccaccggccccggcgccgcgacgatgggtcgatggtgattctcggctatgccgttctggcctatgtgacgttcctgttcagcatcgggtgggcggtcgtcttcctgaccggcccggtggacggcccggccacccactcccccgccaccgccctgaccgtcgacgccctgctgctgctcgcgttcgccgtccagcacacgatcatggcccgcccccggttcaaacgtcacctgccggccgccgtcgagcggagcaccttcgtgctcgccgccagcctggtcctggtagccctgttcgcctggtgggagccggttcccgcggtcgtctggcggggcagcccgctgctctgggtgctgtacgcggcgggctgggcgctcgccgtcgcggcgacctacatgatcgaccacttcgacatgttcgggttgaagcaggccgtccggcgggacgcgtatcaggcgccggccttccgggagcgctggctctacaagcgggtccgccaccccatgatgctcggcatgatcatcgctttctgggcgacgccgacgatgaccgtcgggcacctgttcttcgcggtggcctcgaccggctacatcgcgatcggtatccgtttcgaggagcgtgacctgcggcggcagctgggcgacacctatgcggagtatgccgcccgggtgccgatgctgattccgggcacgcggcgcgcgcactcgaaagttgcttagcatatcgaaaggcatcaggatcttacgggatggatccgttcaccagggtgccgctcggccgcaccgatctcaccgtgacccgcctcggcatgggcctggccccgatcgccgggctgttccggccggtcggggacgccggggcgatcgccgcgatcgacgccgccggggatgccggggtgcgcttcttcgacaccgcgccgctgtacggcgcggggttgtccgaggtccgggcgggccgcgcgctgcgcggccgccgggggttcgtgctgtccagcaaggtgggccgccgcctggtcccggccggcgagacgcggaacgagctgtggtccgagccgtccggcgcggcacaggtctgggatttcagcgatgccggcgtacgtacgctgtggcgcgccagcccggaccgactcgccgtggatcgcctggacatcctgcatctgcacgacccggacgaccatttcgggcaggccgtgcacgaggccctgcccgccctggtggagctgcgccgccagagggtgatcagtgcggtttcggcggggatgaaccagtcggcgatgctgaccgacctcgtccgcaccgggcagctggaccgtgtgctgctggccggccggtacccgctgctggaccagtccggcctcgccgacctgctgcccgagtgccacgcgcggggtgtcgcggtgatctgcggcggcgtctacaactccggcatcctgaccgatcccgatggcagtcccacctaccactaccggccggctccggcggcgctggccgcccgggctcgggcgatcgccgcggtctgcgaccggcacggcgtgccgctgcgggccgccgccctgcagttcccgctcgcccacccggccgtcgtgtcggtgctggtcgggatgcggtcggccgccgaggtcgccgacgccgccgcgatggctctgcccggtccggatctgcgcgcatgcgcccgtacgtcgacatcgctcccgatcttccgggtcggaccggctcatgtccggtgcgaaccggccggtgtgcgaggtggtggcgtcctgcggggaggtcactctggtgctcaccggcattcccggcggccgctccggcgctgcgtccggccgcaccgcgatccgcgtctatcgatgggagatctcgtgaggtatctgcgcgccggagcgccgggggcggaacgtccgattctgtacgccggggggcggctgcgcgacctgtccgaggtgaccgcggacatcgacggggcgttcctggccgccggcgggttcaccggggaccccgacgagctgccgccggccgatctcgaccatcaccggatcgccccgccgatcgcccggcccggcgtcgtcctctgcatcgggccgaactacgcggcgcatgccggcgagtccggggcggcgccgccggccgagccgatcgtcttctccaaggcgccgaacacggtgatcggcgccgaggacgacatcctgatcccgcccgggtcgaagcgcctcgacggggaggtggagctgggcgtcgtgatcggccgccaggcgcggtatctgtcggacccggcggccgggctgcagtgcgtggccggctacgtgctctccaacgacgtgtccgaacgtgattaccagctggagcggtccggcgggcagtggtccaagggcaggtcgtgcgagacgttcaacccgctcggcccgtggctggtcagcccggacgagctgcggttcccgctgcggctgcgcagctgggtgaaccgggagccgcggcaggactccagcaccgccgacatgatcttcgacgtcggccacctgatctggcacctgtcccagttcaccgtcctggaaccgggcgacctgatcaacaccgggactccgcagggggtggcgctcggcggccgcttcccctacctgaacgccggcgacgtggtggagatggagatcgacggactgggtcggcagcgcaacgtggtgaaagggtgagaaacgccgcgggaccgggccgtcgaacgggctcggtcccgcggcaggcgcgggagtcggcgtcctcgaccctcggccccaccgcatcgcccgccacctgtgctcccccgggcgcgccgcctctcgtccggttgcgggaggcgccacgcggatcgccggccgggcacctgcgtcagcggatagcaatagagacatatgtcatcacccacatgtgcaaccttgccgaagccgctggtcaacgggccggaaacgtgagtgaccgtccggtaacacaagatcacatgccacggaaatgctcttggcctcgtctatgcgggtgtgcagcaggaatccatcgagaaacgaaccgtccgctggcgccgactggtgaccaccgtcgtcgccgtactgttgttctgggtcggcgcgggggcggccgcagccgaggcgtacgtcgaatccgtgccggtgcccggcgtgagcccggagccacaggcgtccgtcctgtactaccgcgacggtcggaccatcctggcccgggtcggtgccaccgaccacaacgacgtggcgctgtcggccgtctcgcccgagctgcgccgggctgtgctgatcgccgaggaccgcgacttctaccaccacgtcggcgtctccctgcgcggcgtgatgcgggccatggtggccgacgcgggcggcgcgcaccagggcgcctcgacgatcacccagcagtacgcccgcaacgccttcctcacccagaacgtcacggtgaaccgcaaggcccgggaattcgcgctggccctcaacctggaacgcgagcactccaaggacgagatcctggagcggtacctgaacacgatctacttcggtcggggcgcgtacgggatcgccgccgccgcgcacgcctacttcgggatcaccccggatcggctcgacttcgcccagagcgcggtgctcgccgcggtcatcaaggatccctggggatacgacccggaccacgacgccaaggcggcccggcggcgctggaactggatcttggcgagcgcccaggccaacggctgggtggacccggcggtgacgtacccgcagctgcagccggccggctcgccgatcggcggcccgctcggtctggtcgtcgaccaggtggaacgcgagttgtccacccaccagatcacctcccagcagctgcacacccagggcctgcaggtggtcaccacgctggacgcggcggcgcagcaggccgcggtgggcaccgtcgcggcacaactgcacggccagccgtccggcctgcaggcggccctggtcgcggtcgatccggcgaccggtggggtacgggcgtactacggcggcgagcacggcagcggctacttcgactacgcggcggctctgcacccggccgcgtccacgttcaagccgatcgtgctggcggccgcgctgggtcggggcatcgcctatcagtcccactgggacggcagctcgccgcggttgttcccggaccggggcgtgcccctgcgcaaccacaacgatctgcagtgcgccgactgcacgctgcagcacgcgatggtcgactcgctgaacacgccgttctacgcggtgaccgcggagatcggcccggaccgggtccgggacatggcggtgaagctcggcattccggacacttaccacggggccaagtcgatggtggatgtcaagggtgacccggcccccggccacacccgcggcgacatcgccatgggtcgttacccggtcacgccgggcgacctggccaccgtgtacgcgacgctggccggcaacggcgaccggcaccagcgccacttcgtgcgttcggtgaccggggcgaccggcttcgactacaccgagccgaccggcggtaccgccgcggtcgacccgaagatcgccgccgacgtctccacggtgttgcggtcggtggtgcaggagcacggtttcaccccgggtcgtccggccgccggcaagaccggcacccagcagtacctcgagacgcgcgacaaccaggacgcctggatggccggctacacgccggaactggccaccgcggtgtggctcggcagggcgaaaccggggccgctgcgcgacgcgaagaacaagcggatcgagggtgacacgatcccggcccagctctggcgcgagttcacccggtcggcgctgcagggcgcgccggtcacgccgctgccggcaccggcgcacgtcgggcgcgccgacacgggcgacttcggcaagaccggccacggcggacacagccccgactcggtcaccgatctgcacgccgccgcggccggttacgagccggtcgtgcacaccgagcaccccggcaaacggctcgcgctgaccttcgacgacggcccgtccgactacaccccggcggtcctcgacctgctcgcccggtaccacgtcaaggcgacgttctgcatggtcggcgagaacgccggctggtatccgcagcaggtgcgccgcatcgtggccgacggccaccggctgtgcaaccactcgatgcaccacgacgacctgggcatcgtctcggaggccaagagtcgggcggacatcgccgagacggacgcggccatcgccgaggccgtcccgggcgcgacggtgacctactaccgcgccccgtacggcgacttcggcccctcggcgaaggccggcggcaaggccgggcacaccccgctgggctgggtcgtcgacccggacgactggacgctgcccggcgtcgacacgatcgtgtcgcggatccgggcgcagctgacaccgcgggcggtggtgctcgtccacgacggcggcggcgaccgcaagcagaccgtggaggcgctgcgcaaactgatcccgggcctgctcgccgaggggtggaccttcgacttcccggagacgacgatcacctcctcgccactgcccggcccgcacgccggcgccaccaccccggcgccgtccccgtcgtcggcgtcaccgtccgcatcggcttccccgtcaccgtccgcctcgacctcgccggtgcccgtccccacgccggcactcccggcgaagaccgacgcgccgcggccggacaccacgccgtgacactgccgccgccgccggcacggtgccggcggcggcaccggatccgcggcgatcccgacggtcggcctcggccccacccgggccagcgacgagaaccccgtcccgcaacgcgccgtcaacggcggcgggggcacgctgggtgcggagggtcttggcgtaacgtgtgggatcatgccggcgtggtgattcagccggtcgaggctctcaagggtcggagttgagcatgtctcacgccgcggacgacacgatcgggagcgatccgttggcggtcatgacgttgtcctacctggatgatcccgagatcgcgttgcgtgcagacgacctcgaagccgaacatcgaacgaacacgtggcactacagtgtgccgaaccgctttgacctcaccgccgttgccgccgccctggaacatgtcgttcggcacctggcgaagcgacacggccccggcccgggcatcttctactgctggtacgacgaacaggctgggcagcttcgctgttcgttgacatccaagcccgcggacagtctcccgttcggtggtcgttaccgattgacgcccgaggtcaccgatgtacttcttcttgcggcctccgatgctcagccgggaaggatcccctggacggagctgaccgaggttcagaactcggccgatctgagccggcagaatccggatcccttccccgtgtgggccgccgctctgtcctgaagcaagctctactcccccgctgacgtcgtccaccgtgtccccgtcggtgccgctgagggtggtcagcgccgcccggaccggtggaggtgccgttcacccgggacgcgctgcgccggatgctcggcggggtcggggtgccgcacctggctgtccggctgggcctgcaggatccggagcacaccgccccgccgcacaccccgcggctggccaccgagcaggtcgtcgagatcgtctaggaaccgccgtgcgggtggtcgcccagcaggcgggtggccagcaccgcggcctgggtgcggcgttccagccccagcttggccagcaggctggacacgtagttcttcaccgtcttctccgccaggaacatccggccggcgatgtcccggttggtcaggccctcggcgatcagctccaggatcctgcgttcctggtcggtgaggccggccagctcgcggggctgctccacgccgtgccggatccgctccagtacccgctgggtgaccgccgggtcgagcagcgactggccctgcgccacccggcggaccgcgtcgaccaggtcggtgccgcggatctgtttgagcacgtagccggacgccccggccatgatcgcggcgaacagcgcctcgtcatcctcgtacgacgtgaggatcaggcctttgatcgtcgagtcgacggcgcgcacgtcccggcacacgtcgatgccgctgccgtcgggcaggcgggcgtcgagcaccgccacgtcgggccgcagcgccgggatgcgggccgccgcctcgtgggccgaaccggactcaccgaccacctcgatgtcaccggcggcctgcagcaggtcgatcaggccgcgccggacgacctcatggtcgtcgagcaggaagacgcgaatcatgggttctttctacacgtgagggcgccgcggcggccaagctagcctgtgcggcatgggtgatccgattgccggggacggaccgccgtcgctgggtttgagcccgctgtcgcgggtccgcctcgacgagctgctgcacgagatgctcgaccgggtcggcgaggtgatgtccagccgggagcggctgcgcgccctgctcgacgcggtcgtcggcatcggcagcgacctcgacctgcgcagcaccctgcaacgcatcgtcgaggcggcatgcgcgctggccggcgcccggtacggcgcactcggcgtgatcggcgccgaccgcacccagctcgccgacttcatcacgcacggcatcgacccggcggcgcacgcccggatcggcgacctgccgcacggccgcggcgtgctcggcctgctgatcaccgatccgaaaccggtgcggctgccggacatcacccggcaccccgactcgttcggcttcccgccgaaccacccgccgatgcacagcttcctcggcgtgccggtccgcacccgggaccagatcttcggcaacctgtacctcgccgagaagcagggcgccgccgagttcagcgaggacgacgaggagatcgtcgtcgccctggccgccgccgcgggcgtcgcgatcgacaacgcccgcctgttcgccgtcgcccagcgccgggcccgctggctcaccgcgaccgcggagatcaccagcgtgctgctcggcgacgtgcagcgcaccgatgcgctgcggctgatcgcccgccgggcccgcgagctgtccggctccgatctggtgatggtcctgctgcacgacgaggtgaccgggcggtacacggtcgaggtcgccgacggcgccgacccgggctgcgccactctcaccggcaggtcgctgctggtcgaggacacggccctggccgacctgggtcgggagacgtatcggcacgtgccgcgcctgccgacggtcgccgactggccggtcccggtgcccgacggtccggcgctggccgccccgctcagcggcaccgacatgctgcacggcgtgctgctcgtcgcccagcccagcgcccagccgctcggcgacgaggacgcggtgctgctggccagcttcgccggacaggcctcgctggccctgcagcgggcccgcgcccaggaggaacgcggtctgctgctggtcctggaggaccgtgagcggatcgcccgggacctgcacgacgtggtgatccagcggttgttcgccaccggcatgcagttgcaggccgcgatcgtccacgccacccgcccggaggtggcggaccggatcaacaccgcggtcaacgatctggacgcgacgatccgcgacatccgctcgtccatcttcgagctgcgcgccccggtgggtccgtcgctgcgggcggagctccgcgaggcggtgaccgcggcggccggcaccctcgggttcaccccggtgctcgacaccaccgggccgatcgacagtgtggtgcccgacgacgtcgttcccgagctgctcgccgtgctgcgcgaggcactgtcgaatgtcgcccggcacgcgcaggcgcgcagtgcccgggtcagcgtgcacgccggcaacacggaggtcacgctgcgggtggaggacgacgggatcggcttcgatccggcgcgggcccgcggtggcctggtcaacatggccgaccgtgccgacgacctgggcggcacgttcagcacggggccccgggcggacggcaccgggaccacggtgacctggcgggtcccgctcggcacttgaccatcggcaaccgactccggcaccggccaccgggccgctccccggcggcgaccgaaccccggaaaaggtccttcggccctgaccaccggcccgccggcccggcatcgtgaaacaaaccggcgtttcctggccgcggcggtgacctgccgagaggactgatgatcatggccacctacgacgacaccgacctgcaccgtgccgccgccgcgggcatccgcgcaccgtcgctgcacaacagccagccgtggcggttccggctggccggcggcgccatcgagatcctcgccgacccgtcccgccagctgcgggtcgccgattccgcgggctgggccgcccggctcgcgtgcggcgccgccacctacaacgcccggctggccctggccgtcgccggccgccccgccgacgtgctgctgaccgccgacagcgaccgccccgacctggtcgcccggctcacccccggccgggagcgcccgcccacatacgccgagcaggacctgcacgccgccatcacccgccggcacagccaccgcaacccgttctggcccgacccggtcccggccaccgcccggatccggctggtcgaggcggcccgcagcgaacacgcctggctcgacctgctggtcggcatggccgccctggccggcttcgcgcagatcgcgcacagcgccgaccgcgtcctgcgccgcgacaccgcgtaccaggccgaaatgatcgcctggaccgacgccggcagtgcccccgacggcatccccgcacacgccggcgccccgatcaccgaaccgcaggacctgctcccccagcgcatcctcagcgaccggcaccgcgcccccggccgcgactacgaacccgaaccgctgatcggcatcctcggcgtcgcgggcgaccgccgcctcgaccaggtcgtcgccggtcaggccctgcagaaggtgctgctcaccgccaccgccgccggcctggccacctcgctgatctcgcagccgatcgaggtgcccgccgcccgcgaccagctccgccgttccctgggccgcaccgggtacccccagctggccctgcgcgtcggttacggcaccaccaccggcccgctcaccgggcgccgcgacgtccccgaggtgctgaccggcgcgccggtcacgcaggcacagtcccggtagaaggtgaggtcgttgccgggaaccgggtgcacggggcgtcaccaccggttcggccatctctcagactcgcggccgccctgccgatgggctccaggagagaacccccgcgaagatggagttccgaatgggcgcaatcgttacccgagcagctccgatcgggtcggggcacagttgcgggagtgacgcggcgacagccgccgccgagtcggtgctgcaggcactcggcggccgggtgccggccgccggtgacctcgtcatcgtctttccgaccttcgacctggagcccgcgatcgtccttgccgcggctgaggcggcggcgggcgatgccacggtggtcggctgctcgtcgttcgcatcgttcaccgaggccgagcacgtgtcggccggttgcaccgcggtctacgtcccggcccacggtgcgtcgttcggcgtggccgccggcgaaccgcttgccgatgacatcgccggggtcacccgccaggtggtggaatcggctcgcgcgaaagccggcgtacggcacccgcattcggtcctgatgatcctttccgacggtctcgccggcgaccagcgtgaggtgctgcgcggggcatacgcggtcgccggcgccacggtgcccatcgtcggcggcgcggcggcagaaccgttgcggatggccaggacgtaccagctcggcgagggccgcgtgctgcacaacggggtggtcgccgtgtggatcaactcgcccgttccgctcggtgtggcggtccagcacggctggcggcccactggcgagcccatgatcgtcacgcgcgcggagggcaacgtgatccgcgagatcgacggccggccggcccgcgaggcgtacctcgcgatgcgtggctgcggtaccggtgaggacaccggcatgtccttcgcgggtctcgtgatggaccggcccctgggattgccgaacgcctccgggcggttcgacgtgcgccacatcctggactgcaccccggacggtggtctcgtcatgttcggctacgtcagtgactatgcggtcgtacaggtcatggagagcagtttcgaggagctcatcgacgcggcccggcaggcgaccgccgaggcggtcggccagcttgccgggtcaccgaggggcgcgctcgtgttcagctgcaccgcgcgcaccgccctgttcagtgagcgggtcggtgccgaagccggtgcggtgcgagcagcgttggccggggcgcaggccggtggtctgttcacctacggggagttcgcgagggtctccggctcctccggtttccacaacgcaacggtctcggtgctggcgttctgatgaccgacaccatcccggcggacgttgtaccggcagactccgcggagctggcccgactgcaggaggaggtccggcagctgcgcacacagatcgccgcctcgcacgccacctccgcacgtgcgttatcgcgagccacccgcctggcacaggtggtgagcgtgctcggccagctggccgatgtcgacgacatcttcgctcgcgccgccggcgaggtggccgagctgttcaacgccgatgtcgcgctcttctggctggtcacggaccatggcgtggagctgtccggctgctggggaatcccggcacatgatctgcccgccaacgccgctgagctgccgcccgacctggcggccacgcgacgcggcgagacggtgacggccggtccggccggccaggtgccgttgcctgcctggctcaaccgtgacggcgtccagcacgccgcctgggcgcgccttgccagtggcgcggagaacctgggctacatgctgctgatacgtcattccgaatcgccgttcgacgcagccgactccctcgagttgcgcgcagtggccagccgggtggcgctcgccgtcgacaacacgcgcctgcagcggcgtacccgcatgcagctggagcggctgcgccgcctgcatgatctcacctcgaatctggtcggcatgctcgatcttgatgaagtcctgcacgcggtcgcccggatgacgatcgccgaggttccggtggacgacgtgacgatcgccctgcacggggatcacccggagccgatctcggcgtccgccgggaaggtcctcccgagtgccgcggaccaggccgatggtccggacaccaccgcactgcgcctccacgccggcggccgtgaggtcggaactctgacggtgcacggagcgccgccggccggcggtgaggccgacgcgctgctacgccacctggcagatctggccgcgctggtgatctcgaaggcgttgctgttccagcgggtcagagaacaggcggaacacgacacgctgacccggctggcgaaccgtgccctgttcatggaacgcctggagcaggcggtggtcgatgccgaacgcaccggcggcacggtcggagtgatcttcgcggatctcgacaagttcaaagcggtcaacgatacgtacggccatgacgtcggtgacgcgttgctcgtcgccatggccgcacggctgtccgcggccgccggtcctgcccacctggtcgcgcggctgggcggcgacgagttcgtggtcctctgcgcgccgctgaccgatccggcggaggcgcgcgccgtcgccgatcggctggggcgcgtgctggaggcgcccttcgagctgggcggcacccgcctgccggccggtgccagtttcgggctggcgaccaccggcgaggccggctacgacccggaggcgctgctccgcgctgcggatgaggccatgtacaccgccaaggccgctgcccgtaccgcggcgaaccgggcagaaccctgactcggaactcctgacccgatcgggcgcatcggcatgacctgccggcgcgcctgcgggactgaacaacgccggcgtctggcagcggctgcatgaggttctgctggccgggctacgcgcggccgtagcggcttcagcagccgaaaggctgtctcgtatctctcatctgagctgttgaggcacggggcagccagcagggcaccgatcgtgaaagacggcgggggcaccccgggtcggcggaagcaatggctccctgaaggtcacagccacccaccgccccggctgtcgagaggacgctacaccgggaggacagcagcgcggcgccgaccgcttcggctcaccattggccgcccgacccgtcgtggttggtggcgagcatcgtggacgcccagtggtcgtcgcctccgcttccggtcccgcggagcgaggtcctcctctgccgctggttcttcgccaggcctcgcagggccgtcgccgcaacctcgcgaggcgccctcgctcgccgccgaaccaggagaaccacagcaagcgcggccggcaccacgccgatcatcactgttgtcaccacgcccgcactcctcatgtccgtagtgtgcgcacccctggcaaccgccaccgactgcccggacgcagcgggtcatgccgcagccgaagccgagctcgttgagcagccattccccagcggatgccggtgaacaagacgaacaagatgccgcacgacccgtcgtggtcgtcgaccggccggcgaccagggcccgaccgtgaccgctgcttggggaccagcgatatgctgccgaggcataccggcttccggaccgccccggctaccgcctactcgtcacgccggccggtgatcgcggccagacgacgagctcgccgctcagacacagtcccagtagaagcgcccctcccgcaggtcctcactgaggaacgcgtatccggtcccgccgccgaagttcagcgtgaacggattgccaccccagccgtccgacccgtccagctggaagaagaaccgccagctgtcgtccagcacctcggacgtccacggctgccagaggatcggctcgccccccacgtagctgcgccactccacgtacgcgtcgtcgtcaggctccggcagcccaccccgggccgcccgctggaacgccgccgcccgctcgaacgccgccgcgtcggccggatccggatcacgaagatcaagagacaattcagccggtacgcggtcctcccacgacgccccccgccgccacaacgacggcccgctccggcgcgcctccccccgcacgaaccccggcacccgcccgcccggctggaccagcagcgcgttctcccaaccctccgccaggaaggtgccgtcctcgtcgctgaggaacaggtaggccatccgggtatccggccccggcagcgggaactgccccacgaacgtcatcgccgcaccggacgtcccggacaccggccagaacggctcatccagccagaacggctgcccgccgagcttggcgaccggcccatcgatcgcccggtcaccgacccgccagaacaactcccgccgcggcgtcagccaccgatcgaacggccccgccgcccccggcgacagctccgcatcctccagccacaccatcggcccatcctgccacccggaccaggtcttcgacgtcttcctcgacctgtgctccgctcgtgcactcccgttggccggtgagtcgtcggctctgcgcccctcgggtcgcggcgcatcgcgcgggatcagccggtcagtggcccggaccggtgatgattctgcggcgttcggactcgtgggcgccgcccttgttgtccaacgtggcgcaggcgtcgtcgatgtcctcggcgagcaggtcgacatgttgacgggtcatggtctccttgaccagcgcccgcatgatcgtcacgtgttgggcgttcggcggcagggtgtaggcgggcaccatccagccgcgttcggcggacaactgccacgccaggtcgaactcgtcgtatccgttgtcggcggccaggcggaacgccaccagcggaagctgctcctggtccgcaccgatcagctcgaagcggttcatcgccgccagcttctcgccgagcgtacgggcgttggcccgcatgttcgccatgatgtatcggtatccggcacggccgtagcggaccaggttgtagtactgggcgaggaccatcgcggatcccgtggagaagttgagggtgaacgtcttgtcggtcttgccgagatagttctcctcgaagacgaggtcctcggccagatccgcccgttcccggaagatcagccagccgatgcccggatagaccagaccgaacttgtgcccggatacgttgatcgagcgcacctgttcgaggcggaagtcccacggcgagtccgggtagaggaacggccacacgaaaccgccgctggcggcgtcgacgtgcagcggcacgtccaggccgcgctcgcctctgatccgtagcagcagatggttgaggccggcgatgtcgtccttgtgcccggtgaacgtcgtccccagcacggccgcgactccgatcgtgttctcgtcgaggtggggttcgacatcctccggcccgatcgtgtacctgccgggccgcagcggcacgatccgcggctccacgtcgaaataccggcagaacttctcccacaccacgtggacgtcgccgccgaagaccaggttcggggaaccggtgtcaccacgccgcttgcgccagttccacttgagcgacagaccggccagcatgatcgcttcggaggagccctgggtgcgcgcgccggtcgtctcgcccggagcgtggaagaggtcggcgatcatccggatgcagcgctgctcgatctccgcggtgagcggatactcggcgtggtcgatgaagttgcggtgcaggttggcggcgatcaggcgctgcgcctccggctccatccaggtcgtgacgaaggtggccaggttccgggccgggtcgccctccagcgccatctcctcggcgaccagccggaaggcgtcggtggccgtcataccctcgtccggaaacgtccggctcggcacctcctgcgtcacgaaccggttgccgaacagcgcggcgtcggcgtcagtgctcatctgtccccctgcgaatagtggccggaagcatcaggacggcgacggtccatgaccgctcgacgtcactcaacccgcgctggacgacctcagccggcgacagcgacgccggcgggcgggctgccccggcagcggctccctccggccagcgcacccggcgacgacgaccgcgccggcgatcagcgaaaccctcgcgcggtgcccgatcatccgatccgtcctccactgtcggcggcggctcagtctggcgcggcggcccgccgattccgtcatcccccgcggatgaccggatcgccccgcggcgatacggcgatgcggcggtcggcgagcggttcgaggtcacgcacacgccaccgtcgaccttgctcggcggctccgggggaacgagggcgaaggccacgacggcggacgatcgaacgccgggaagcccgggccgccacaccgggcggcgaagagctggagcagatccgtctgatcgcccggtcgcccgcccgccgacccggtgaaccggcgcatcggcgccgagggtcgatagactggccgatgccgccagagtcggcatgcagctcggaggaaagagcgatgggatgaccgccgccggcgtagtggacaccgccgcgctgtcgatgttgtgggacgaccggtggcccggctgttcgaagctgccttacgagcttcgcgatgtcagagaccggtggatacggtttcacactctgcccggatccaagcgctatcccggatcggatgccgagtacgagatggtcctcgcccggcacaacaacatccttgacgagttggtgaccggcccgacggtcctggtggccactgccggttattccgacaccgcacagccacagcaaccatgccggtcaccggagaccctggccgtgcacccacgcgccgtgtattggacgagcgtctgcatcgacgacgagccggggttcgagagctggatgcacctgtacgtcagccggctgtcctggtcggtagggtgcctggatccgttgttgcgtcgggtcgctgacgatgtgatcgccaacgtgctggtcgcggatcccggcttgcgatggctgtatcacccctatgacggcggcatggacgtcatgctgtccaccacggccgagcgtgacgctctccgggaccggcatcaggactggttgtcttcgcacccgggcggcttgtgactcgcatctgacaggatcgccgagggacgtagggtgagcttctctcgatgatcgagcaccgtgccggtatgtacgtcgaccgtccgaggtaggaccgcgctttcgccgtggtgaccggttctgaccttgcgcgcgggcccggtgaacccacgggcttccaggggtcggcctcggtgcgcacggcggccctacggatttccgcagggccgccgccgtaccactccgccggaatcagccgcaggcggtgccgttgccgtccgcgtcgagcttctgccggtccttgcccaccaccttgatgtgggtgaaaccgtgggccgcgagccaggcacagtgatcggtgaccccggtcgggtagaccagcgggatgcactgcgcctgcgtcccatagttccggtcacagccgtcgaccgtcggcgccaccttgaccggcgtcttcggcgacttctgcgggcggacccgggcccgcccgggctgggccgcgaactgctgcacgaacggcgcgggtgccccgtgcggccggggccgggcgcccgatccggagcgggaggtgttctcctcccggcgctgcggagaagcggactgggcggcggccccgggcacgtcaccgaccgggtccggcgagccggcgaaggaggccgacgggctgacgaaagatgccggcgagcccgcgaaggaggagggtgacccggtgaccgtccaggccgccgcaccgcacaccgcggcggccgccacggcgattccggcgaatcgaatccggatcatccgacatgcacccacttcgcgactgaggggactccgttggtgccgaccgcgaacagcatgtaccagccgggcggcgccaggttcgggttgctggtcaggttcaggccgatggtgttgccggtgaccgtcatcggcaggtcgacgaaccgctggttcgggtcgctggagtgggtcaccgcggccgggcggatcagttcggccttgaggatcggcgcgtcgacggtgatcgtgtgcgaggtgccgtacgcccactgggtgtcgggcatcgcggtgatgtgcgggcgcgcgccgttggccaggtagggcggggagtacaccgagatccgcatgtcgaaggtgccgttgccggggttgtcgccgaccgccatgacccggccgtcgggcagcaggaacgccgacgagtggtaggtgcgcggcaccgggtcggtggccatgccgggggtgaaggtgttggtggccgggttgtacatcgacgcctcgtacaccgggtcggcgcggttgtgcaggccgccgccggtctcgaagaccttgccgtcgggcagcagcaccgcggagacgtacatcttgccctgggtgccggtctccgggacgccgccggtgagggtgcccccgggcagtgccgggccggccgtgtagaccgggttggcctgcttgaggtcgatcaggtcggtgagccggtgcgcgtccgggttggtctcgatgttgccgccgcccatggtcagcaccttctggtcctgggcgggcggcagcagcacgctcatcgactggtcgcgctggtccttctggcgcaggccgtcgaccggggtgatggtgttggcggtgtagttgtagatcgacgagccggtgccgggcaggccgttgccgaagacgtggctgccggtgtagaagagccggccgtcctgcatcaggatcatcgacgggtacaggccccagaagttccagctctggtgtgcctcgttgagtccgagccagcgctgttgggcggtggcgaagtactgggtggcgaccgtgccggaggagtcctcgccgaggccgccgagcgagatgatgtcgccgttgcccatctcggtggccgacgggtaccacgatccggaggtcatgtcgttgacccgggtgtaggcgttggtggccgggtcgaagacgtacgaggtcttcaatccttcgtagccgtggctgccgtcggcggccggatagtccttgttgccgcccatcaccagcacccggccgtcgggcagttgcacgtgcccggagcagaacaggtcggccggggtggccaccgtggtgaaggtgccgttcgacgggtggtagacggcggtcttgaaggtcttggccgcgaagtcgtccgggttgttgccggagccggcgaccagcagcacgtccccgttgcgcagcaccaccgagtggatgctgcggaccggcgagttgaacggcatcaccgcccaggtgccctgggtgcaggcggcgccggcgctgcaggactgttccggggcgggctgggtggcgtcgttcatctggtagtcgtcggtcagcagggtgccgacgccgtagatggtgatcccccagacgatctggtcggtgttggccggcacctgcggggtgcgcacggtcttctgggtccaggcggtggtcaccggcagggtggccaggtcggtccagtacacccagccctgtgcgacgtcgtgccggaacatcgtcatcacggtgttcgcggtgctggtctggtaccaggcggacagatcgtactggtggcccggcgtgacgttgggcgcgcacgaggtgtcttcgagcatcatcgccttgcggtcgccggagccggccgagctgatgctgatctgcatggcgttggcgccgctgtgcgcggtgtgcgagacggcgaagctgtagccgctggagccccagccggacttctcccagcagaccgggaagccggtgctgtccagagcttccaggccggggttgccgaccaggttggcgctggcgccggccggcagctgaggcaggccgacgaagagcgccagggccagaactatcagctgggcgatgcggagccggttgcgccggctcatcagtggacggtgcgggtgggtcacggacgccccaaacgggtcggtgggtgggttcatcggggccggccgcccagtcgcagccgaccgacgtgtttgaggaaccgcaggccctcggacacggtcgacttggattcgccggcgaaccgggcctggaaggtgtagggcacctccacgacgcgtcccggccggttgcgcacgatgagttcgagcaggatcttgtatccgagcggccgcagccgccccgcgtcgagcgagctggcccggatcgcgaacagcccgctcatcgggtcgctgaccgccagcaggctgttccggaagagggtcttcaccagcagcgtcgacccgcgggacaccagtttgcggtatccgtcggccagtcccccggtgctgccgccggcggtgtaccgggagccgaccaccaggtcggccccgtcgcgcatcccggccgcgatcaggtcgggcacgatttccggcggatgctgcagatcggcgtccatcaccacgatccattcgccgcgggcgatccgcatgccctcgaccaccgcgccgccgaggccgcccgcaccgtcgtcgcggtggtgcacggtgatcggcatcgggtaggtgcgggccaggtcgcgcaggagggccacggtgtcgtcggtgctgtcgtcgacgaagacgatctccgtctcggtgtgcggcagtgccgcggcgagccggtcgagcagcgcgtgcacgttgtcccgctcgttgtacgtcggcacgatgatgctctgccgcagtgcggtgcgggcgccgggcacgccgatctcgccgggcagcacggcccgggtccgcccgggcttgcgataccggtcgagcgggacggtcttgtcgccgggtgtgacggtggcccggatcggggaaccgggggtgacgatggcccggatcggggaaccgggggtgacgatggcgcgggcccgggagccgggggtcatgagttctcctgtcggttgatccggcggacctcgatccggccgccgtccgggccgaacccggcgaccactgtcgagtgggtcagcagggtgttcacggtcggcagcgcgctcgggtcctgccgcagtgccggggtggagacgatgtagtccacgtcgtgccatccgtgcggcagggtggccttcaccgccgggtccaggtcgagcttgtagaaccagatcaccttctgctgctgatatccggcgcgcacgcagtcgagccacagcacgtcgtcgacgaccacggtggtgtgcgcccggtccagcaccgcggtgcgcaggtagtcggcggccgccgcgtaccccgcgttgtcctcggcggtcagcgcccgctcgttcccggtccaccagcgcggcaccaccaggaccgcggcgagcagcgcgagtacggccagggcggccggccggatccagcgccgcggcgccagcaccgcgagctggtcgagggcgccggcgatggcgatcgcgaagaacggcaggatctgcaccacgtacatggccggcaggtagccgccgggccgcagcgccacgagggtcaggatcagtccggccacggcgggcggccgcagacgacgtaccgccacgatcgcaacggtcgcgaccaggccggcgatcagaatgatggggtcgtagaacaaccacgagtgcagcagctggttggcgccggatccggtggtgaagatgctgcccgagcccgagcggttggccagctggaactgccaggcaccgatcagcgagacgtgcccgggtccggggaacagttcgccgcgcagcagggcgtacagcggatagaacgcgccgaccagcaccagcccgctggcgtaaccgccgatcgcccacggccgggtcgaactgcgcgccgcgttctgccagagcgcgaccagcaccgcgggcagggtgaccagcatggtctccttgctgagcacggcgatcgcggtggccgcgccggccgcggtgacgtgccacaggtgccggcgcggggagaggacgagggcgagcgcgccgagcatccaggcgaccgcgaaactgtccaggtagatctcccggtccatggtgacggccagcggggacagtccgaagatgagcagtgcggcggtggccgaccagacggccatccccatccgccggcagatcgtgtagaccagcatcaggctggccgcgatcacggggagcatggcgatccgcccggcggccacggccgggctgtgcaccccgaacacgccgggcagccaggacagcgcggcgagctggatccacgccagcggcggatggtcgtaccagtaggtgtagtgcgccaggccccggccgtgcgccaccgcccaggcctgcgcgaggtaggtgccctcgtcgtcgctggcgccggggaagccggtgatgttgagcgcgtagaccgtgaggatcagcgcggtcaccgtcaccatcaggtaggtctcggggttgcggccgcggcgtcgccgccgggcgggttgttcggttgcggtggcgattgcttgggtacggtcgtcagccgcgtccaggagaagactcacgccgcggcaccggcctcggcgggcgtggcattgccgtgcaggtgggcgccgacgtgcgcggtcagctcccagttgcgccggccggtgtactcacgccacaccgcgcgcagcgccgccacgctcaggaccaacgcgtacgggaaggcgccgagggtcagccaggcatagtgccggaagccgatcctgaggttgtactgcaggccgaagtcgcgcagcccgacggtctggaacacgatgttggccagcatcggcaccaccggcacgaaggtggccagggcgatgccgaccggcaggtccgcccagagcgccgcgcccaccccgaccgggatggccaggccggagaacgcctgcaggaacgggccggtgagggtgtagcgggcgagcagccgctgccggaacgacggtagccggcgccactcccccttgcgcagcacctgcaggaagccctggttccaccgggtgcgctgcttgagcaggctgccgatcgagtcgggcgtctcctcccgggtgaccagcgacgcctcgtaggcgacgaccaccttggcgccccggctggacagccgtaccccgaggtcgcagtcctcggccaggcaggtgccgtcccagccgttggcggtgcgcagcacgtcggtgcggacgaacacggtgttgccgccgagcgggatgaaccccttgtcggcgtgcaggtgcagccggctgcggaaccagaagaagtactccaggcagttgtgcaggctgtaccagctggagtggaagttgatcagctgcacgccgccctgcaccacgtcggcgccggtggcccggaacgcgtggtcgacgtgttccagcaggtcggggtggacctggtcctcggcgtcgaagacgccgaccacgtcaccgcgtacgtacggcagcgcggtgttcagcgcccgcggcttgttcttcacctcgttgtggtcggtgaccaccaggatccggtccggcgcgctcgccgcgacccggtgggccaccgcggccgtctccgggtcgtcgtgcccgatgatcaggatgatctcgtagccctggtgggtggagcgcagcagccgctccaccgtgtgttccagcacggcctgttcgtggcgggccgggacgagcagcgagaaggtgacccggtgatcgccgtccggctcctcgaaccgggtggcggccagcgtctccggcgtacgccaggcgtgcatggtccaccacagcgtcaccgcggcgaatacggagagcacgacggaaattgaaatcatgacggcggcagccaagatcggaggccctttcggcaaactgcggcagctcaacggaaatggtgtgcggcgagactttatcgctgcgcgccgggtgcaattcaagtcgatcagagcacattcccctgatccagtgagccgtgccaatatagccgctattgtccgtttggctacgcttgcacagatccgaaaatctgggacaagacatgaaaaggcatccgccccgaccgtgggagcggatgccttttcgttatcgctttcaagaaagaaggtaaaccatctagcctatttcccgacatcccgcttgcgggggatctcgcggcgaccttgccaagatcgattcgccggtacgcggttacccgttctagcaggtggcggacctccgccaccccgcggcgcgcccgcccgggccgggatcacccgatcgggcgcggcaccgcggagggggatcagtccgtgtcggtggagagcagctcgtagtcctgggcggtgacctcaccgctggtcgccggggccggctgcacgccggtctggccgtaccgcgagatccggatgaccaggggcggctgtggggtgatcggctcggccggctgcgaggccatccgctggtcgggcatcgacacggtgaactcggtgagccggccctgatcgtccagcacggcccggtagggcatcgctttggcgccgacgccgtacaggtaggtcgggtcgttgaacagcttctgcagctccggatccttgccggtggcgtccagcgtcccggtgatcacggtgccggatcgctgggcgctggtcaccgcggcaatcagcgtcccggctccggtggcgtcgggccgccgggcgtcgggcagccgggccatggagtccaggccgctctgctcctcgatggcggcagccgcgatcagtttcttctcgtcggcggcgacccagtgctcgccgtcgagtcgggcgtagctctgctccaccgagcgcagctgggcgccgctgagatgtttgcggtaatacccgagaagctgggcgcgcagctccgggttcgcgtcgagcaggtatttcaggtagaagtgcgggcccacgcgcgccatcgcgaaggtgtcggagtgctcgatcagcacgctgtcgggcaggtgcacgacgccctgccggatgtcggcgacgtcgctggcgccgctgcgggtgaaggtgtaatcgccggcggccagggcggtcaccgagtcgcgcagcgcctgccgggcgtcgccgggcagggcggtcccggcggccgggcggtccgcccgatggtccgggccgagcacggtgatcgcgaccggcacggccagcaccgccgcggcggccgccgtgacgacggccagtcgccggcgcgtccgccggcggtgcgcgaggtgcagcacaccggtgggcgggagtggatcggtggagcgggccatctcgttcatggcagtcctcaggtcgtcttcggtaggcatggtcgtccctcagggccggtggtcggtgtgctcggtgaggctctcgccggacgccgggtcggcgaagctgacccggagcttgcgcagcgcgcggaaacaggtcgacttcaccgtgccgagggtgacgccgagcgcctccgctgtctcccgctccgtgtagtcgtccaggtagcgcaacaccacgacggcgcgttcccggggggcgagagcgtccagggcggccaggagcgagtggcggtcctcgaccgtgttctccatcaccggcggcaggtcgggcagcacgtcgaccggctgctcgtgacgctggtgcgcggtgcgccaccagtcgatgaccgcgttggtcaccgcccggtgcagatacccgtagggatcgtcctgctcgatgtgctgccaccggcggtaggcgcggaccagggccgactgcacgatgtcgcgcgcctgctcatggtggccgcacagcagttcggcgtgcgcgatgagccgaccggagcgcgccgccacgaaggcgctgaacgtctcgtcggtatggcggcgttgtctgactctcatgatcactaagacggcatggccgggcgaaaggttgacagacccgccggccgatcgcgttggcatgtttccgggattcgccgggcgcggccggtcggcatgctcatggacatcacacgcatcacgggatgcgggatcgtcctccgggggagaaaaagatcgtgaacgttcgtacgccgctcgtcgtcgccgccgtcgtcaccgccgccgccctcaccggctgctccagcaccgcgaccactagctagctagcacgcacgcgccgaccgggaagccggccgcttccgacggctgcaccccgtcggaggcgacgctgctcaaggcgctgcgcaccggcaagctcgtcggcgtgctggcgccgaccgacacgctgaccgagatcacctgctaccagggttacgcgctggcgctgacccacccgaaggaggccgacaacgcccgggcggtcttccactacaccggtggcgcgtggcacggcatcggcggcggcacctccgactactgcgagggcatcgtcccggccgccgtccagccgcacctcaagcactgctgatccgccgcccgcggtgcagggtgccgctgataccggcgacgtcgaggtccaggccgcgaccatcgtgcaggtgcaggtgcaggtgcggctcggtgctgttaccggagttgccgaccagcccgacctgctcgccggcccggacctgctgacccggcacgacccgcaccgaccccggtcgcaggtgggccagcacgacccggatgccggcccggtcgatgacgacgtggttgccgaacggcggtccgtagcggatcacccccggcacctggtcgggcaggccgtcgaccgcggtgacgatccggccgtcgcacggcgcggtcaccggtgcgccgtacgacggatggtccgtcagtctccggccgcctgcgccaccgggccggaccaggtccaccgcgccacgctgctcggggacgcgccggtggtggttgagcccgcggccgccaccctggaccacgtaccaggtcccgcgcagcgggaacgcggtcagcctcgcggcgctcccccaccggaaccgccgcccgcgcaccagcagcacaccgacagccccgaggagcaacgcacccggcacgacccgccacgcggcgcccgcgggcaggcccgggacccgccccaccgcggcgaacgccaccaggaactccgcctccaccagccgtcgccaccaccggggcagcgcacccggagcgccgaagccctcgaacagcaccagcccggccagcagggccagcagccggcccgccgcgcccgccaccgacccggcctgccagcaggagaccacccagcacgccaggcccgccccggcgacaccgcgcagcaccgccggccgcgaccacggccgtcgccgcggccggtagcgccggccgtcgacgagcaggccggtcagccgtccgtcgcggacccgcgcccaggccagcaccgccccggccggaccggtgaccagcagcccgtccggagcgtccgccaccccggagatcccgccgacccgctccccggtggcggccacgatcgcgcgcagccggtcctcgcccacccgccgcaccacctcgggcgcgagctgcggccacacccgcgggtcggcggtcaggaagcgccgcagaacctccgcctcgtcggtcatcacgcggtgagccggtgcccgtatccggtcgccaggggcagcagatccggttcgccgtacgcggtgaccatctcgccgaaccgctgcgccttgcccggcccgaagcgggcgacgctgaccgtgtaggccgccgccgacacgaacaccggcgggttcttcttgctgtggaacttgtcggcgtacatgaccagggtctcctccggcgtctcggccacatagtcgcccggcggcagcggcaacccctggtcgagcacgtccgcccgggtcaccccgacgccggtgtggcaggaacagaatcggcacaggtagtccggccagccctgcgcctcgaggagttgatgcccgagcagcccgtgccggatgtagttcgggtagtcgagcaccccgtcccgcccgtacagccggtagaccccgatgtcgtgcagcaggcagccggcccggaccagatccggatccaccccgagctcgcggcgcgccatcagctgctcggcgatccggcagacgatttcgcagtgcgtccacaccaggtcgaacgcctccggagtgggggccacgcgctcgtgcaactgccggatctcggcatccgagggaatccacatgtccgcgaatcattccaggcggccatgggtgtccccggaccggatccggcgcgaatgtggggtgggactaccgatgcgccggccccggccgggccggagggtggtgagcggcgcgcaggacccggcggccacgaggtggggagagaccgtggagacgttgcaggcacatctgttcgggcgcgacatcgacgggctggccgccctgctggtgcgggccggcgtccgggtcaccccgctgcgggacgagccgcaggcgaccgtggtggtcagcggggccaccgtcgccgaggccctcgacgcctgcccggagacgtaccgcaagcagcggttcggcctgctcgtcgtggcggagtcgctcgacgccgccggggtgcggcacgggttccgggccggggtgcgcgcgatgctgccgcgggccggggtgactccggaccggctggccgcggccctgcattccgccggccagggtgaccggcggataccctacccggcgatggtcaagctgctcgccggcgcggcgccggcaccacgggagctgtcggccgagccgctgaccccgcagcaggcccgggtgctacggatgatcgccgaggggcagagcaacgccgccatcgcccgggacctggcctgctcggagcacaccgtgaagaacgccgtgtacgacctgatggcccggctgcatgtgaacaaccgggcgcacgcggtggcccgcggcatccggaccgggctgatctgaaccaccgaatccgggtagttcctacgcctgtcccgcgaccgcgcacccgcttggctgggcggcatgacgggtgaatcggtgaatgtcagtgtcatcgcgctggatcctgtgctcgaagccggcacgcgcagcgcgctgagcgatcgtcccggcgtggcggtggtgggcgtgggggtgcccgccgcggtcaccatcgtgatcgtcgacgaggtcgacgagcaggtgctggacctggtccggctgacccgggcggcgccgcaccggcccgaggtggtggtggtcgccacggaggtggcgcagccgcaggccctgcacgccatcgcctccggggcccgcggcctgctgcgccggcgggaggcgagcgcggcgcggctgacccgggccgtgctggccgcggcgagcggcgactgcaccgtaccgcccgatctgctcgacgatctgctggacacgggcgcgcgcggcccggcggtcgccgggctgaccgaccgggaacgggcggtgctgcggctggtcgccgacggccgggagaccggcgacatcgcccggacactgtcctactcgccgcgcacggtgaccagcatcgtgcacgacatcacccagcggtaccggctgcgcaaccgggcgcacgccgtcgcgtacgccatgcgggtcggtctgctgtgaacggtgagagtgcctgttcttctctgccgcgggcgccggccgctggcgactctggaggacgtcacgcagctccagggattcacgcagaacagaggaacctcatggcgatcgcacccgtcacccggcaggtcaagagggcatccgacttctcggtcttcgaagatctcgagtccgacgtccggatctactgtcgcaagttccccgcggtcttccaccgggcgaagggcgcggagctctacgccgaggacggccggatgttcatcgacttcttcggcggcgccggcacgatgaactacggccacaacaacgagtacatcaagagccgggtgaccggatacctggccggcgacgggctgatgcacggcctggacatgcacaccgtcgccaaacgggagttcctgtcggccttcgccgagctcgtgctgcgcccccgcgacctcgactacaaggtgcagttctgcggcccgaccggcaccgacgcggtggaggcggcgctcaagctggcccgcaaggccaccgggcgcaccggtctgatcgcgttcaccggcgcctaccacgggatgtcgcgcggctcgctcggcgtcaccggcgggttgcgggcccgccgggccggcggcgtcaccgcgcaggacgtcaccttcatcccgtacgaggacggaccgcacggcgccttcgacggggtcgcgctgctcgaacgcctgctcgacgatccgtcgtcgggggtggcccggccggccgcggtcatcgtcgaaccgatgcagatggagggtgggatgtatccggcctccccggactggttgcgccggctgcgcgcggtcaccgagaagtacggtgtgctgctcatcctcgacgagatccaggcgggttgcgggcgtaccggcacgttcttctgtttcgagcgggccgggatcgtgcccgacgtcgtcaccgtctccaaggccatcggcggttacggcctcccgctgtcgatgaccctgttccggcgggagctcgacgcctgggagccgggcgagcacaccgggaccttccgcggcaaccagctcgccttcgtcgccgccaccgccgcctgcgaactgtggcagcagacccagttccgcaccgacgtggtggccgcggcccggcggctggagcggttcggcgcggagatcgcgcggacgcatccgggcgtcgcggtccgcgggctcggcacggcgctcggcatcgacctcggccgcgacggcggcggcggcggtccggagcgggccgcgctcgtccagcggtacgcgttcgaccacggcgtgctggtcgaactgtgcggccgccacgacgaggtcgtcaagatcctgccaccgctgaacatcgacatcccccggctcgaccgcggcctggacgtgctgcgcgacgccctcggcacggtgtgagaccacccgcggcacccaggaggagacatgcgcacgcgacggcacctcatctcgatcgacgacctcagcgacgaggacctgcgctggatcgtgcgccgcggcgcggagtacagcgcgggcaccgcgggcggcggccgcccgctcgacggcgacatcgtcggtgtgctgttccgcaacacgtccacccggacccggaccgcgttctcggcggcggcgctgcgactcggcgggcggctcatcacgtacgggccgcaggatctgcaggagaacaccggcgagaccgcgggcgacaccggcgcggtgctgtcccggatgctcgacgtgctggtggtgcgcaccgccggcggggacgccgagctgcgggcgtacgcggcgtcgcggcggatggccgtgatcaacgcgatgagtgccagcgagcacccgacccaggcgctgaccgatctgaccacgctcacccgccacttcggtggcgtcgacggactgcgcgtgctctacgtcggcgagggcaacaacaccgcgtcggcgctgtgcctggcgctgtcccggttccccggcaccgagctgcacctgcggacgccgccgggcttcggcgtcgaccggtcgttcctggaccgcgccggctcccgggtcgtccagcgccacgacatgaccgacctgccgaaggtcgacgtcgtctacaccacccgatggcagaccaccggcaccaccaaaccggtgccgaactggcgcgagctgttcgcgccgttccaggccgacgatgcggtgatggcggccaccggcgccggcgtcttcctgcacgacctgcccgcgcaccgtggcgaggaggtcaccgccgagttgctcgacgggccgcagagcatcgccttcgagcaggccgagaacaagtaccacagtgcccgggcggtgctggaatggtgctcccggtgagccgcgccggcgcgcgggccgcgatgtacaccgccggcggcatctcctcgttcggcacccagatgaccatgctggcgctgccctggctggtgctggagacgaccggttcggcggcccggaccggcgtggtctacgccgtgcaggtgcttccgctggcgctgctcggcttcgccggtggcggcgtgctgcagcggctgggcgcacggcgcaccatgctgctgggcgacgcgttgcgggcgccgctggtggccgccgtcccgatcctgcacgcggccggcgcgctgagcttcgggctgctgctcaccctggtcgcggtggtcggcgtgtgcggcgtcccgtacgcggccgcccagcgggtgctggcgatggacctgatcggtgcctcgccgggcgcgctgacccgggcctacggcgtgctggacggcgtctacaacgcggcggcgctgggcggtcccgcggtggcgggcacgctgatcgccgtggccggcgccgccgacgtgctgtggatcgacgccgcctcgttcgcggtctccttcctgctcctgctgaccctggtgccgggcggcgccggccgggccgcggcggccggccgggatcgcggcacctgggcggggctgcgctatctgcgcagcgaccgggtcctcggccaggcggtgctctcgacggtgctgttcggcctggtgctgcgggtgctggcgttgagcctgccgctgctggcgtacacccggttcggtcacgacgcccgggccgggggcctgctggtcgccggctccggtgcgggcgcgctgatcggctcgctggtcacctacctggtgtccacccgggtggagccggtgcgcctggcccgcgccgccatggtgatgatcgccctgccgctgtggttcctgctctggcccgccccgcccgccgcgctggtggtggcggtcgccgtgtcgtcggcggcggtgaccgtctcgaacgccccctacgccgcgatcgtgagcacccgggcaccggccggcgtgctgccggccgtggtccagacggtgatcacgatcagtaccctcgccgggccgctgggcctgctgctggccggggtgctgaccgaccgcgccggcatcggcgtggtcctgctcgccgtcgccggcaccgccacgatcgccgccgtcaacgtgctggtcgcgctctcccgcctgcggcccgctccggaaaggacgctgggacatgtctgaccaagtgcatctggccggtggctggcggctgtggagccagttcgcgctgcgcgggcccggtttcccggccgacggcgtactgcggctggctcccgccggtctcgccgccgcggccgacaaggccgcccaggcgccgccggccggcccggagtgggcggacttcaccggactctacgatgcggccgcggtcgccaccgcgctggagctgcagcgggtcgcggcgctgccggccttccaggccgccgtcgcctggcagaaccgggccgtgctcggcaccgggatccgccccttcctggcctggcagccgagtgcggccgggcggaccagcatgccgcgccagcgggaggagctcgtcgcccactactggcagcggttctgcgtcaagaacgacaccatcggcttcttcggcccggtcgggtggggccggatcgaccgcacggtgccgggcgtcgtggtcgaccccggcgaccggttcctggcggcgtccgaggtgtacttctccagctgggcgatcgacgcggtggccaagaccgtcgaacagattccgggcctgcgcgagcacgtcgccccgcgccgcgtctcctacgcccggatcggcgcggacaccgtcacggtcgccggcagccccgcccagccgatcgacgccgaggcccggcggatcctcgccctgtgtgacggcgcccggctgccggccgagatcgccgcggcgaccggccggcccgccggtgaggtgctggacgtgctggacgtgctggcccgccgccgctggatcgtgtggcgcctggagatccccgccgacacccacccggaccgctggctgcgggccaccctggcgcgcatcgccgacccccggatccggcaggacgccctgtcccggctggcggtcgtggagcgcggccgggaccgggtgcgggcggcgggccgcgacccggccgcgctgctggacgccttcgaccgcatggagacggcgttcgccgagctgaccgcgacggccgcccagcgggagaagggtgcgcggacggcaccgtgccgggcactgacgtatgccgacacccggcgcgccgcgaccgtccgggtgggcgcggccgtgctggccgagctcaccccgctgagcttctgcctgaccgcggcccgttggctggtccaccggttcgccgaggtcgccgagggccggatccgggaacggttcgagacactgcgcgccgagctgggcaccgtggatctcgcctcgctgtggatgcggtgcatccccaacccgtacgccggagcccccgacgacgccgaggagatccgccgggagctccagcgacgctgggccgcgatcatcgacgcgccgcccggcgcccgccgggtgcggctgcgcgccgccgacatcgccgaccgggtcgccgccgccttcgacgagcccggccgcggctgggccctcgcccgctacgcgagtcccgacgtgttcgtgctggccgacagcgccgaggcggtggcccggggggacttcgagctggtgctgggcgagatgcacgtgggcaccaacaccctgacccagtcgctgttcgtcatgcagcacccggacgcggcggagctgatcgccgagaccgacaccgacttccccggcccgcggctgatgccgatgctgcccaaggagtccaaggcactgcgctggtcgacccgcagccgaccggccctgatccggccggcggactacctggtcggcgtggtcgaccacaccgccgacccgcatcggccgcgcaccctcgccggggccgacgtcctggtcgaggagcgcgacggcacgctggaagcggtcctgcccggcggcgagcggttccccctgctcgacgtgttcggcaacgcgctgaccaaccaggtcatgaaccggttcgccgtgcagcccgacgagggacacaccccccgggtcacggtcgaccggatggtgctctcccgggagacctggcggctgcccgcggacaccctgcgattcgcggccgagaagtccgaggccgcccgcttcgtggccgcccgggcgtggcgggagcaccagggcctgccccggttcgccttcgtcgtgtcaccggccgagccacggccgttctacgtggacttcgacagcccggtctacgtgagcatcctggccaaggcgatccgccggctcagcagggccgacccggtggccgtgctgaccgtcagcgagatgctgcccacccccgagcaggcctggctcaccgacgaccagggcgcccgctactgcagcgaactgcggttcgtggcggtcgaccagagcaccggaggcccgcgatgatgcccaccttcgtatccgagctgccggacggcgacactccggcgctcatcacccccggcggcagcctcagccgccgcgacctgcaccaccgctcccgggccctggcctgggcgctcgccgcccggcaggccggcccggagaagatctgcgtcgtcgccctggcggacggcgtcgaccggatcgtcgcggtcaccgcgaccgtgcgcaccggggcggcgttcctgatcgtcgacaccgacctgcccgaccagcggctcgccgccctggcccgcggcgcggacctgacgatcaccagcgcggccctggcgccccggctcgccgccctcggcctgcccgggccggccgtcctggtcgacgacacccatcccgagctgcccctgcccacccgggtggcgccgcgctcgctggcctatgtcagccacacctccggctcgaccggcacccccaacgcggtcctgatcgaacaccgctggatgcatccctacctgcgcggcatcgtgcgcgactacgacctcggcccggacacggtggccgtgcagctcgccccgcccggcttcgacgccgccctgcgcgacacctatgccccgctggtcgccggcggccgcctggtggtcctgccgcgcgccacgctgctgcggccggcgcagttcttcgcggccctggccgaacacggggtcaacagcatgctcagcgtcacgccctcgttcctcaccttcctgctcggacagccgggcgccgagcaggccctgcgcggtctgcggctggtcgcgacgaccggcgagccgatccgtccgttcctgctcgccggcggacgccggctgatcgccggacggctgatcaaccagtacgggccgaccgagtgcacgatgaccaccacccgcttcgaggtgccccgggaaccggacacgagccgggacgtgatcggcacgcccgtcgacggcaccgcggtgcggctggcggccggtggtgagctgtgcatcgccggtcccggcgtcgcgcgcggctacgccggccggcccggcctgaccgccgaccggttcgtgcccgacccggacgggccgcccggcgcccgcatgtaccgcaccggggacctggcccggcgcgggccggacggcaacctggagtacctcggccgccgcgaccggcagatcaagatccgcggttaccggatcgaccccggcgaggtcgagggcgcgctgctcacccacccggccgtgaccggcgccgcgatcaccgcggcggccgacgacagggcccgcacctacctggtcgcccacctgaccggcgacctggccggggtcgccgacgccgcgctgcgcgcgcacctcgcccggaccctgccgccgcacatgatcccccggcgcttcgcccggctgcaccgcttcccgaccacccgcaccggcaaggtggaccgcctcaccctggccgcctcggaaaggaccgctcgatgagcaccaaccagaccaccgatctcaccgaactgatcaccgagatctaccgggagacgctcgcggacgccacgctcggacccgactgcgacttcttcgaggcgggcggggactcgctggccgccttccagatcaccgcccggctccaggagcacctgggcaccgacgtaccggtggcgctggtgttctcctatccgacgccggccgacctggccgagtgggtgcgctgagatggccggttcggagagcacgccgctgctgctcggcggccggttccggctgtgggaacagttcgcgctgcgcggcccgggtttcccggccgagggggtgttgcggctcgtcgccccggaactgtcggcggccgccctttcggaggtgccttccccggaggccgcttttccggaggccgcttctccggaggccgcttctccggaggccgcttttctggagacctatgacgcggccgcggtgaagaccgcgctcaccctgcaggagatcgcggcccggcccgactacaaggccgcggtggcgtggcagaaccgggcgctgctcgaccgggcggtccggccgttcctgcgcgcgcgccccgcgtcggcccgcaccagcaaggaccgtcagcgtgaggagctggtggcccactactggcagcggttctgcgtcaagaacgacaccatcggcttcttcggcccggtcggctggggcaggtacgaccccggagtgtccggcctggtggtcgagccgggcgagggcctggtcgagcggacgaacatctacttcgcgagctgggcgatcgacgctctggcccgcagcctgggcgccgatccggtgctggcccgctgggtggccccgcggcgggtcccgttcgtgaccaccgcggccgccctgcccggctgcccggcccaggatctgtcgccggagctgctgcgggtgctgcgctactgcgacgggatccggacgcccgcggcgatcggggaactgaccggcacggatcccactgaggcgctgtccgaactggtccggcggcggctggtgcactggcggctggatctgcccgccgacgcgtacccggagcggcatctgcgcgcctggctcgagggggtcggcgacgatgacgcccggcggcgcgggctcgaccggctcgaccggctcgaacgcggtcgggagcgggtccgcgcggccaccggcccgggcgagctggcggccgcgatcgaggcgctggagaacgacttcgccgcgctgaccgacgccgcctcggcccgggagaagagcgccggcacggcacccgggcgcggcctgatctacgcggactgccggcgatccgcgtcggtccgcgtcggcggcgacgtggtcgccgccctcgccccgctggagctgctcctgtccagcaccacctggctcacctcggagttggcccggcggttccgctcccggatccggcaggtgttcgacgagtcgcgcccggccgacctggccgccttctggttcgcctgcatgccggtggtgcaccgcgacgccccggccgacgcggccgagctgcagcaggagttctggcgccgctggcaggacatcctcggcccgtgctcggacgcccgccgggtacggctgcgcctcgccgacatcgaggagcgggtccaccacagtttcccctcgaccggcggtggctggccgtccgcccgctacctcagcccggacgtcatgatcgccgcggcgagcgccgaggcggccggccgcggcgagttcgcactggtcctcggcgaactgcacgtcgccatcaacaccctcggcgccgccctgtacctccatcagcacccgaatccggacgagatgctggagctgaccacccgggaccacccggcgccccggctgctgccgatgatcgccaaggagaaccgttcccggctgtccatccggatccgctacagcctggcccggcccgaggaccactacgtcgcgttggccgacttcaccgcggacccacgccgcccccgtacggtcaactgcgcggacgtcgccgtccaggccgacggcgacaccctgttcgcggtcctcccggacggcacgcggtacgacgtcgtcgacgcgttctcccacgtcctgaccaccctcgtgatggaccggtggcggatcctgcccgaagcggaccacaccccgcgggtgaccgtcgacaaggtggtgctggcccgggagacgtggcggttccccgccgccgagcagggcttcgccgacgcgaagacggaggcgctccggttcgccgcggcacgccgatgggccgcggagcggcagctcccccggttcgtcttcgtgacctcgccggccgagccacggccgctgttcgtcgacttcgacagcccggtcttcgtgaatctgctcgccaaggccgtccgccggctggtgcgcaaggacccggcggcccggctgacggtgagcgagatgctgcccaccccggagcagacctggctcaccgacgaccagggcaaccggtacacctcggagctgcgcttcgtcgcctacgacacggcacgctgagcacccggctgatctccgcggcggtgggcttggtggccggatctacgattctcgatcgtgacgacgacaccgggcacgatacgagtcgcgatccagatcccaccgtcgcgggcggactatgcggccatccggcgggccgtggccgaagccgacgcgctcggcgtcgacgcgatcttcaactgggaccacttcttcccgctcggcaaggacccctccggcaagcatttcgagtgctggaccacgctcgcggcctgggccgagtccaccggccacgccgcgatcggcgcgttggtcagttgcgtcgcctaccgcaaccccgacctgctcgccgacatggcccgcaccgtcgaccacatcagcgacggtcgggcgatcctcggcatcggcgcgggcttccgcgagtgggaggccgaggagtacggcttcgcgttcggatcaccggctcagcgggtgcgcgagctacgcgaggccctgcaccgcatcgaacgccggctgcagctgctcaacccgcgcccgatccggcggatgccgatcctggttgccgccgacgggccccaggcgctgcggctggtggcccggtacgccgacatctggcagaccttcgccgaggacgacgtcttcagcgagaagtcgcgccgactcgacgggttctgcgatgaactgcggcgtgacccggccaccatcgaacgggcggtgttcgtcgacggcgacccgtggaccgtcgcagcgccgctgcgtgcgcgcggcgccggcatgttcaccctgatgacccgcggcccggacttcgatctcgacgagctacgccgctggctcgcctggcgcgacgaggagaacgcccgcctcccggtggccgcccggaatccgtgatgatgcagtggtgaccaccttctccggcaccgggcagttcgccggcgcgaccttcgtcaggaccagcttccagggcgccaccctgcgattctccgatgtcagcggtgtgacgatgcgcagcgtcgaggtggacggcctcgacatcgacagccacgacctgttctccggccgtctcctggtcaacggcgtcgatgtggtgccgctcgtggatgccgagctcaaccggcagttcccgggccgcgagctgcagcgggcccagacccccgcggggctgcgcgagggctgggccgcggtacgtgccgcctggcagacgacggtggcggacactcccccggacctcgtggacgcccacgtcgcggacgagtggtcactggcccagaccctgcggcacctcgtcctggcgaccgacgcctggctgcgcggcgcgatcctgcggacgccccgcccgtttcacgagatcggccagatcttcaccggggccgaccggatgggcttcgacatgtcgatcttccgcaccgatccgccggcctacgcggagatcctcacggtccgtgccgagcgtcagcggatggtcaccgactttttggccacggccacgacggacctgctcgccgagcagcgcgacaacccttggggcggcggcgaccggcgtcccagcgtcggtgactgcatccgggtgatcctggaggaggagtgggcgcacctgcgctacatcaaacgggatctcgcccgcctgcgccagcggccggcaacctgacccgtgggacgctgggagccgcggtcaccggctgaccggagatgcagcccggtcgtcggcaccgggctgatcggacgtgatccggtacccgccgccgggcaacggctcggatcggtcggcgatccatgtcgaccacccggccggccagaccgtggaccgatcccacaccgcctcgtcgagcctggccggggtggcccatgccccacgaagatccgctccgcgcaggtccgccccacgaagatccgccccgcccagattcgccctggtgaggtttgcaccgatgaggtatgtcccgatgaggtgcgactcgttgaggtccgcgttggcgagattcgccccggtgaggtccgccccgatgaggtacgcctgatgaaggttcgctccgcgcaggttcgccctggtgaggtccgcccaggagagcttcgccccgaagaggttcgcctcgaagaggatcacctcgatgagcttgaccccgcggaggttcgcaccgcggaggtctgcctcgctgaggtcgtagtgggtgccgaggcggcgagttccctgacggatgacgtcgatcgggggttgagctctaccgttgccgggattggcgcggatccgggcaacggcggcgtcggcgtgctgctgaatgtcggcgtcggtcagggggtccggatacccgtcgcgcaggaggcgggccgccagggcgtggaagctgccgaacgtgcgcggtggggtgacgggatcggtcattcggtggcctccttaccggtggcagaggcgcgggcaagctcctcggtgggcaccggggtgcctttgcggcaccaacaacaccagggaaaatatcgcctggtggtgaagaaatcagcggttgcggtcacggcctggcgtacggcggtgtcgccggtggcggtcttggcgaccgcgtcggtgttgaagactgcctgcacggcgcgttcccagtggtcctcggcggccggccagtcgtgatcgtgcaggacgacgaaggcggcggcgaagccgtccgggacgttgtagccactgtgggcatacacgaggttcttcagcggagggatctccgggatccagtcaggcatccgggtcgtccaacggggtgccgaggacatcggtgatcgagcggctgcggcgggcggtaatggcccgctcgatggtgatgccgatggcggcaccgacgatcgccggggtggccagccagcccgccaccgacaacggccaggccagcgcgggcacggcgaccgcatgatcgcccggggagatgacgccgatggtcacgtcgtaggttgtccgccagcaattgaccaggccgttggtcacatacagcgcgaggaagacgccggtcagaggcaaaccgcggaccagaagccagtgctgcaggccggtgtgcgcgcccaccgcccgcaagcggcggcgccaccgggcccgggtccagaacggctccggcggtggcggcaacagcgggaggccggacgggttcgacgccgcggttgccggtgcgcagggcgcggagccggcagggtccggcggatcgggcatggcggccacggtagtgggccgggaccagtgattccactggccatggtcgggcttccactaatgggcgatgacccgtacggggcatgtcgacggcgtgtcgccgcgccggctcgggcaagtcttcccgacctggcaccgaccgggcacctcgggccggctcccatgatcactgccgggttcgaggcctgggcgagggcggtcatgacggggtgaccggcccgtcatgaccgccgcgtgctgtgtcaggcgtcgtccagcaggccggtgatcagctcggcgaagcggcggacgtgcggctcccgcaggacgctgaagtggtcgcccgggacgcgatgcacccggaccccaccggtgaccagttcccgccagcgggccagatagtcgccgtagctctgccccgaggcgacctcgtgctcaccgcggaccagctcgtcgctggcaatcagttccaggcgccccgggaagacgcggtgccggtagctcatgtccatctccatcacctcccgccagatgcgcaccgcggccggccagtggccggcgccgccctcgggcaggacgatgccggtcgccgggtcgacgtcgtcgaccaggtggtcgagcaggctcaggatctcggtccggcgctgtggcgtgtccgctccctcggccagcaacgcctccaggcggcgcatcagggccagctcgctccagccgtcgtcccggctgtgcatgtccaggccggggtcgagcagcatcaccgtgacctgctcccccgcgtcgatcaaccggtgggccatctccatcgcgatgccgctgccgccgcaccagctgaggatccggtagggaccctccagccgcgcgtcgcgcagttcggccaggtagcgggccgccatctgttcggtgctcggggtgccctgcgggtgcggtccgggccattcgaacgcggccaccggctgctcggggtgcaggtgcgggagcagccgctggtaccagtgcgcactgccaccgccggggtgtacgcagatcagcggcacccgcccggtcccgtcgcgcagccacatcagtgccctgccggagctctgttcggtcagggtggccgccagccgggcgaccgtgcgctgttccaggaaggatcggaaggtcagctcgtagccgtgccgggagcgcagcgccgcgatcacccgcatcatggccagtgagtgtccgccgaggtcgaagaagtcgtcgtcggcaccgatccgggcgacgccgagcgcctcgctccacgcctgcgcgaggtgccgctcccggtcggtgcggggtgcggtgtacgcggcgccggtcgccggccgggatccgtccggggcgggcagcgcggcccggtcgaccttgcccgccggggtcagcgggaagtcgtcgaccgcgcggaagtgggtcgggatcaggtgctgcggcagccggtcggccaggtgcgcacggaggtcggccgccgggacaccgccacgggtgtaggcgacgagggtggcgtcgggcgtgccgggccggtgcacggtgcagaccgcgccggtgaccccggggcaggcggccagggcgtgttcgacctcgcccagctcgatccggaagccgcggaccttgacctggtgatcgcggcggccgtggaagctcagggtgccctcggctgaccgggaggccacgtcgccggtgcggtacatccgctggccgggcacggtcgcgtacgggtcggggacgaaccgttcggcggtcagcgccggacggcccaggtagccgcggctcacgccggccccgccgacgaccagttcgccgcgcacgccggcgggcagcggccgctgatcgtggtcgaggacgtagacgcgggcgttggcgaacggctgcccgatcggcggcgggccggccggcgccgaggtgccgagctcggcggcggccgcgcagaccgcggtctcggtcggcccgtacccgttgaccacccgggtgtgcggggcccaccgcgccacctgttcggcggtgaccgcctcacccgccgtgaccagcacccgcaggtgcgggaagtcgtcgggccggagacggtccagcagggacggcggcaccgtcatgtgggtgacgacgccggcctgggcgcgcaggtcacccgggtcggtgccgggcggcggcagcaccagcgcggcgccgttggtgagcgccatcgccagttcccacaccgaggcgtcgaagctgggtgaggcgaactgcagcacccggtcgccggggcggacgtcgaggtgccggttctgggcgtggcgcaggttgagcagcgcccggtgcggcacgccgacgcccttgggccgcccggtggagcccgaggtgtagatgacgtaggcgaggttctccccgttgagcgccggcggcggggcggcgggcagggtgcggtaggcctcgtggtcgacgatctcggcgccgggggcgagggcggcgtacgccgggtcggtgagcacgaccgcgggtgccgcgtcgtcgagcatgtaccggatccgctcggccgggtaggcgggatccagcggcaggaaggcgccgccggcccggagcacggcgagcatggcgacgacgagatccgtgccgcggggcagcagcaggccgaccaccgtgtccgggccgacgcccagccggtgcaggcgggcggcgagcccgccggcgagggcgtggacctcgtcgtaggacagggttcggtcgccctgccgcagcgcgaccgccgcgccggtcgggaccaggtcgtgcagcagcggcagcgcggggaaggcgaccgggttctggaaccggtcgacggcgtcgtggcggtcggcggccgccaggcccacggctcgggcgtcgccgccggggtcggccgccatggcctccaggacgtgccggtacgtgcgccgcagcagctccaggtggggccgcccgatccgggccgggtcggcaccgagccgcagcacgccggggaaggtccacacttccagcgcgaggctgcccgggctgaagtcgtcgatcatccgcaccccggactcggcctcgccggccagcacgtggaagtcgaggtagccgaacgcgacctcgatcagccgcgaggccgatccccagtcccgttgcatcgtgggctgcgggtagcgccggtgcggccacagccgggcctcctcggcgaacactccggcgaccagctcgcgccacgtgcgggcgcgggtgtcggcggcgaacggcacggtgttgaggtacatgccgaacacctcgtcgccgcgcagccgctccggccggccgttgcagagcagtccgtcgaagaagcgttcctggccggtggcgacgctcaacgccttgaggtgggcggcgtgcagcacgctcttgagcgaggcgttcgccgcggcggccagccgcttgagccccggggccaggtcggcccagggcacgtcgacgatggtggccggggcgccggcgggctcggtggcccactccggcggcagctcgaaccggtcgcgggaggcgaccgtggcggcccagaactcccggtcctcggtggaatcgagggcggcgcgctccaggtggacgaagtcggcgaaccggacgccgggcggcgcgggcagctcgggcggggtgccgtcgcgcacgccgcggtagaggtcgatcagcatcgcgacggtcgcggtgtgactccagccgtccagtatcgcgtggcactcggcgtgggtgagcagccactcctggtcgctgagcaggtgcacggtgtagcgcaccagcggggcccggccgatgtcgaacggtacttcccgctcggcggccaggaacgaacgtaccgcgtcctgttggtccgcagcgggccggccgcgcagatcgcggacctcgaccggcagctcggcccgttcgtgcaccagctgcatgatctccgagtaggtgcccaggtcgaacgaggtacgcaggatctcgtgccggacgagcagcagccgcagtgcctgctccagcgccccggccgcgaacggcttgccgtcgcggatccggtagcaggagacgttgcggtacaccgcccggtccgccccggacagcatctcgtacagcatgccggcctggttctgggtgatcgggtaggcgtcgctgagtcccggcggcagcagacgccgatcggcgtcgctgatctgggtgaacggctcgaccggccgctccggggaggactcggcgcgggacccggtcagctcggcgagcgcggcgacgctctggtgggtgaacatgtcctgcacccgcagggcgatcccggcggcacgggccgcgcccaccacccggatcgcccgcatggagtcgccgccgagctggaagaagctgtcgtggcggccgaccttcgcgatgccgagggcggcgccgaactcgccggcgagcaggttctccacctcgccgtgcggggcgtcgtacgcgccggtcggcaccggggcgtccgggtcgggcagggcccggcggtcgagcttgccgctgccggtcagcggcagggcggccagcacggcccagcgtgccgggatcatcgcctcgggcagccgacggcgcaggtgggcccggatgtcgtcgacgctcgtgtcggtgacgacgtagccgacgagctgtccgtcggcgacggcggccgccgcgtcggtgacccccgggcactcccgcaacacggtctcgacctcgcccagctcgatgcgctgcccggcgatcttcacctggtggtcgaggcggccgaggtattcgatggtgccgtcgggccggtggcgggccagatcaccggtgcggtagaggcggccgccggggtcggcaccgaacgggtcgggcacgaaccggtccgcggtcaggccgggccgcccgatgtagccgcgggccacctgcacgccgccgatcagcagttcgccgggcacgcccaccggttgcggccgcccgcggtcgtcgacgatgtacgcgctggtgttggcgatcggccggccgatggtgaccggctcgccgggcagacagcgcagggcggtgacgtccacggcggtctcggtcggcccgtacagattgtgcagttcgccgccgatccgctcgtgcaccgcgtcggccaggtccgccggcagcgcctcgccgctgcagatgatccgccgcaccgagggcagcgtgccgcacggctcggccaggaaggcgcgcagcatcgacgggacgaagtgcagcgtggtgatccgctcggcggcgatcagggcggcgagataggccgggtcgcggtggccgccggggcgggccaccaccagcgtcgcgccggtcagcagcggccagaagaactcccacaccgagacgtcgaacccggccggtgtcttctgcagcacccggtcgccggcgtccagccggtaggtctgctgcatccactgcagccggttgacgatggcccggtgctcgatcagcacgcccttgggccggccggtcgagcccgaggtgtagatgacataggcggcgtgggcgggggtgaccccgctgaccggatcgctgtcgtccccgccctcggcatcggcgagcagccgctcggtgaccacgatgcgggcgccggcgtcctgggccatgaaggcccgccggtcggccgggtgctccgggtccagcggcagataggcggcgcccgccttgagcacgccgagcagggcgaacaccaggtcggcgccgcgcggcagctcgaccgccaccaccgactccggcccggcgccgaggccgcgcaggtggtgggcgatccggttggcacgggcgttgacttcggcgtacgtccattcccgcccctcgtatcgcaacgctgtcgccgtgggtgtgccggcggcctgcgcctcgagcagggcgggcagtgtgccacccggataggtctgcacgctgccgttcccaccgcgggtgagctgccgcagctcccccgcggtgagcagatccagccggtcggctggggatcgcgggtcggccacggccccggcgagcagctgcccgagatgcccggcgagccgctcgacggtggcccggtcgaacagggcggtggcgtaggtgatgccgccggccagcgatccgtcgggccgctcggcgatcgcgacggtcaggtcgaacttggcgctgctctccccgaccgggatccgctcgaaccgcagtccgcccgcctcgcgaacggtggccggcgtgtcgtccatcaggaacatcgtgctgaacagcggggtccgcgacggatcgcgccccggcgccagttcctcgacgagccgttcgaacggcagatcctggtgggcgtgggcgtccagcgtgacgtcgcgcacccggtcgaggacgtcggagtaggacgggctgccgctcaggtcggcgcgcagcacgacggtgttgacgaacaggccgggaaggtcctggacctgcgggtggtcgcggccggcgacggtggtgccgaccgcgatgtcgtcgagcccggtgtatcgcgacagcaggatcaggtatccggcgagggccgcctggaacgtggtcgcgccacgccgccgggccagctcggacagcttccgggcgaccggcgcggggatcacgaacggcaggaaggcacccgcggggtcgcgcaccggcggccggggacggtcggccggcagttccaccgggacgagaccggccagccggtcacgccagaaggccaggtgctcgtcgagtggggcgccggtgcgctgccagagagcgacgtcggcgtactgcagggccggtggcccgggaaaccggtgcccggcgtagagccggatgagctcgtcgacgagcaggccgtcggaccagccgtcggtggcgatgtggtggatggtcagcgcgagtgcgtgctcgtgcgggccgagccgggccagggtcgcccgcagcaccgggccgtcggcgaggtcgaccggctgccggtcggtggtgcccagggcggcgagccgggcctcggcccgggcccggtcgagcgcgcgcaggtcgagccgggtcagatcgaccggggccgggtcgtcgatcacctgcaccgggtcgccgtcgcggagcggatagcgggtgcgcagcacctcgtggcgggcgacgagagtgtcgagcgcgcggcgcagggcgggctcgtcgagcgggccggtgaggcgcaacaccgtgctggccaggtattcggtggtgcccggctggagctggtcgagcagccagagccgctgctgggcgtacgaaagcggaatcggcgccgaacgatccgccggtcgcgggccggcggccggccgcggcgcggtgacgccgctgagccggcggcgcatcagctccgcgcgcagcgacgccggatccatggtctcggtcatagcgcaccctccggggtttgcgggccacactcgtcggatcatcagggtgccgcccgggcggccgccgggtcagagaacaaccggtgccggcccggtgccggcaagactgcgcgtccttctctgcgccgctgccgtaccgtccgacaaggctcggtgcatgaagacgccggcattcgccagcgggatcaccggcacgatcggtgcgaccccgctcgtcgagctcacgcggctcggggagagcagtccgctccgggtgttcgcgaaattggaaggtcacaaccccggcggcagcatcaaggaccggtccgcgctcgagatgatccggcacggtgtcgccgtcggccggatcgtcccgggtcgctcggtggtggtggagtccagttccggcaacctcggcatcggactcgcccaggtctgcgcctactacggggtgcggttcgtgtgcgtgaccgacccgcgggccaaccagcagaacatcgcgatcatgcgggcgctcggggccgaggtggaggtcgtgacccggcccgacccggcgaccggggaattcctgccggcacggatcgcccgcgtccgggagctggcggcggccctgccgggcggctactgcccggaccagtactccagcccgctgaacccgcaggcccaccatgccaccatgcgggagatcgtcgaggcgctgccggcgccacccgacgtgctgttctgctccaccggatcgttcgggacgctgcgcggctgcgccgaatacgcgcgggagcagcggcttgcggtacggatcgtggcggtggacgcggtgggcagcacgatcttcggcacgccccgtgggccccgggtcatcccggggcacggcgcggccgtacgtcccgccctgttccgtgacgggctcgccgacgaggtggtgcacgtcgacgacgccgcctgcgtggtggggtgccggcggctcgtcgcgctggaggccatcctcgccggcggctcctccggcgcggtcgtggcggcgctggaccgggttcgcgaccggatcgcgccgggttcgagctgtgtcctgatctttccggaccgcggcgagcgctacctggacaccatctacgacgacgactgggtcgccgagcggttcggcgacatcgcccacctgtggaagcagaacgccatggaggccagcccgtgttgatcctgggaagagcagacgtccagcgcatcctggaggatgccgacgaggaggtgctccgggcggtccgggcggcctacctgcgccacgaggagggccggacggcggtgccgcactcggtcttcctgcgcttcccggacgacgaccggaaccggatcatcgcgctgccggcctacctgggcggcgacgacccggtggccggcgtcaagtggatcgcctcgttcccggcgaacatcggagccgggctgccacgggcgaccgccgtcatgatcctcaactcgatgcggaccggcgcgccggaggccgtgctggccgccgagaccatctcggcgcgacggaccgcggcctccgcggccctggccgccggcaccctggccccggacacgccgggagtgacgctgatcggctgcggggtgatcaacgccgcggtgctgcggttcctgcgtacgacgctgccggagttgagcacggtgaccgtcttcgacctcgacgacgggcgggcacggtcgttcgcggaccggatcaccggcctcaaggtggaggtggcgccgagcatcgaggcggcgctgggcgcgcaccggctggtctcgttggcgaccacggcggcccggccccatctggacaccgaccactgccggcccggggcggtcctgctgcacctgtcgctgcgggacctgccggtgcccgccgtgctcgcgagctcgaacatcgtggacgacgccgaccacgtgtgccgggcctcgacgtcgctgcacctggccgagcaggagaccgggcaccgcgacttcatcagcggctcactggggtcgttgctggccgggacgccgtaccggcgtcccgccgatcggctgaccgtgttctcgccgttcgggctgggcatcctggacctcgccgtggcccggctggtgctccggcgggccaccgagcggggcgcgggcgtcgagttcgccgggttctgatccgggccggcgaggcggagccgaccgtcagccacggtatgacccatcagggatgagcgaaattcaccaatgaaacgagatgatcacgtaaatagaaggcaattgatgcctgtgcatcgtctcccgcacccctgccgcgaggaaggggcatccgcagaagtcgatggccgagaagggaaaccacgtgcgcatctcccgacgtcagctctggacggcctgcctcgccgccgggctggccatcccggcggccaccgccgtcgccacgagcgcggcggcagccggcagcaccgccggcctcaccgcgaccgtccagatcggccaggtcaccggcagcgccctcaccgtgcacgtcacggtgcgcaacacgtcacggtcggcgatcgacgtgctgtcccgggacctcccgcaggcccgcgagatcaaagccgtcctggccgtcacccgcgacggtgtaccggtgccctatcgcggcaggctggccaagctcgcggcgccgaccgcggccgactacacccacatcccggccggtggcacctacgcggcgacggtgaacctggcggacgactatgacctgtcacggccgggaaccttcaccgtcgcactggcatcggcccaggtgcggaccctgaacgcggcgaccgcggcccgtccgggcacactgcgggtcgacgccggtccggcctccgtccgcaccagcgccggcatccggcacgccggcaaggccgccagcgtcgcgccgaccaccaccgagcgggtgagcctggcggccgccgcggtcaccctcacctatcgcggctgcaccaccagtgagaagaccgccctgaagctggccgtcagcaacgccgcgacgttctcgcagaagtccaccacctggctcgcggcgaacccgtccggcgggggcgcctacgccacctggttcggcgcctacagctcgtcccggttcaaccgggtgacctcggcgtacaacaagatcaccggcgagctgaccggcaagaccgtgacgctcgactgcaccagcaccgaggactactacgcgtacgtctacccggacgagccctacatcatctacctgtgcaacgcgttctggacggcgccggccacgggcaccgactcgaaggccggaaccctggtccacgagtcgagccacttcaccgtcaacggcggcaccgacgaccacgtgtacggccagacggcggccaggcagctcgccgcgtcgaacccgggcaacgccgtcgacaacgccgacaactacgagtacttcgccgagagtcgctgacccgcgatcggccggctccgaccggccgcccgtcatgaccgcacgcggggctgtcccgatcgggacagccccgcgtgcggtgccggatcgccggatcaggagccggtgtagagcaggcggttcggcgagccgctgccggcgccggtgaccacgccggtggtggccgcgttcacgatcgccgcgttcaccgtggcgaccgaggcgcccgggtacgcggccaggtagagcgccaccgcaccggtcacgtgcggggcggagaaggacgttccgcttccggtgtacgtcgcggtgttgccggtccgccagtccgaggtgatcgagacgccgggggcgaacaggtcgagcaccgagccgtagttcgaccaggaggccctggcgtcggagctgtcggtggcgccgacggtcagcgcctcggtcacccgggccggggagctcccgccggcgtcgactcccgagttgccggccgcgatggcgtacggaatcccggcgccgatcgaacggcgcaccgccgcgtccagggtgctgctggtgccgccgccgaggctgaggttggcgaccgagcggccgggggtggcgtgggcggtcacccagtcgacgccggcgatcaccccggaggtgctgccggagccgttgttgtccaggacccggacgtcgacgagattcgcgctcttggccacgccgtacgtggtcccggccgcgacaccggcgacgacgtgccgtgcccgttgccgtcctgcgcgacgttgtcgccgtcgaccgcgtcgtagccgtacgaggcccggccgccgaagtcctgatgactgacggtgatgccggtgtcgacgacgtagacggtgacgccggcgctcgggccgtacgaataggtgccgctcagcggccgcgcccgctggtcgatgcggtccaggccccagggtgcgccgctctgggtgtcggcgatccgcacccgctgatcggcctcgacggaggcgaccgaggggtcggcggcgagccgggcggcctgcggcgctcagcttggcggcccacccctcgacggcgtggccgaagacgtgggagacggtgccgccgtaccgcttggtgatctggtccgcgcgggtctggtcggcctcgccgcgcttgagcacgacgacgtacgagccgccgatcgcggtggcactgtccgcgtagagcaccgttgcggtcgcgggggcggcgaaggccggggtcgtgagggagagggcgagcgtgatgccggcgaggatcgcggcactgcgggtagcggggcgcatggtgtcctccatggtcgcggcgccctggccgggcacctggcgacgacagcaggagcagaagtttgattgacgatcaacgatatgtaagcctctcggcaacgacctttgtcaattttcgtcacgattgcggaaaaggcgaggtcaggcgttgatggtgacagttgtcagctttccggactgacgtcactcacccgcaaccgatgacagcgcgcactgggctgacctcgagtgggcagccaggcttgtcgatgacagtgaacccaggcgcatcgttatcgcaggagaaacggatgacacatcggcaacgactctcgatgatcgcggtcatggtggtggccgcgttgggactcagcttcacgggtgcgagcgcggccggcgccgccccggacaccccggtggccgcgccaccggtgaccgccctcgccaccccgatcaccggcacggccaccgacggcggctccttcgccggcagcttcaccccggcccggttcgtcgcccgcaacggcaggctgctggccaccggcgtgctttccggtacggtcagggacccgtccggtgcacccgtcggcacggtcagccgcaccgtcagcctgcccgtgaccgtggcggcggcgacctgtcaggtgctcgacctcgtactggggccgctgcacctgaacctgctcggtctggtcgtcgacctgaaccaggtacacctgctgatcaccgcggtgcaggcgcccggcgacctgctcggcaacctgctgtgcgccatcacccatctgctcgacggcgccccggcggtgggcccgctggccgcactgctcaatgccgtcctggccttgctgggccggctctgacccgtcccgctcccgccatcaggaccggcgcagcgcaccccgccaggtgcgctgcgcccccgttacgtcagccagccggcgttctcggccaaccggaccgcctcccagcggttgcgggcgccggtcttgcgcaggatcgccgagaggtagttgcgcacggtgcccgggctcaggtgcaactcggcggccatctcggtcgacggcatcccggatgcggccacgctgagcacggtgagctcgcgcgacgacagtggactgcgcggcgccgtcaccatggccacggccaggctcgcgtcgatcacacgctcaccccggaccaggcggcggatgccgcggaccagttcgcacggcgcggcctgggtgttgaccacgccgtcgatgcggccgccgagcgcccggttgagcagcaccgactcgtccgggccggccagcgccagggtggcgcaccgcggttgaccggcggtgaaccgggcgatcgtcgccagaccgtcgccggccatcagcgcaatgttgatcacggccacgtccggcgacacggcgccggccatgtcgagcgccgggccgagcgcgtccagatcggcgaccacgtccaggtcgtcctcctgggacagcgttgcggtcagggcgccgcggagcagggtcaagggttcgacgagcagaatgcggatcacgatggcctcccagccggggtcgaagagcttcggtacggccggatgccggccggtttccggatccctgcggggaggctggtcagcggggaggccccaggtggcggacggtgcgtccgcgagcgggcagaggggtgccccggtgcggcgtggtggccgggacgtcgggccaccacgatgaacagacgatggccatcgcgggcgcgttgccgccaccggcgtcacggatctgcccggtggaggccgagtgctcgcccggctgaccgggcgaagccggtaccggggcgctcggcgctggagcgtacggggacgcgcggcgaggcgccggggcgccggcgccgggcgtggtcaggatcggcgtccggcgcaccgagaaggagctggaccgcggcatgcccggcccgggcgacgcggccggccccgccgggccggccggtgaaacaggctcgtccagctggggcagcgcctgtcgaaccgcggccgtccgggccgggaccatcgtgtcggggagcacggcccggccggtctcggacacgaggtgatgcaccggcttcgtggcggctcgcacccgacggaccgtcgcaccggccgaggcgtgaacggcggcgacgaccggggctgcggcgcggatgcgcggcgccgcgaccgtgcgacgcggcgccgcgatcgtgggccggtgaacctcggccccgggcaccggtgcgtgggcgacggctctggtgacgccaccggccacggtcgtgagcgggtcgaccgcggccggcgcgccgagggagcccgacggccggtcccccaccccggtatcggcacgcgccgcatgatcgaagagggtcagcacgagatacgccgcgacggcgacgccgagcagcaggagcagccggacgacgcgccgggtacccccgggcgcgtgatcctctccgtgcgcggctgggtgtcgcattcccttcgacttacccggcccgcacgcgctgacacctatcgatgaaaccaaggacccggtgacgccgccgcggcttacccgccgggttgcgggaccgtcccgatcgcgacggcgggcgacaggtgctcaggcaccggccatcaggcgacgcaggctcagcggccgcatgtcggtccagacgcggtcgatgtgggcgaggcacgtggcccggtcaccggtcgtgccctcggcggaccagcccggcggcaggtcccggtcggccaaccagatggagtactgctcctcgtcgttgacgaccacccggtaggtgcgctcgtccgtctgctcgtcgttcatggccgccgtccctgtctcctacggtgccgggcgatccggctaatcggagcttgcccgctgtgtcacggcggcggcagagaagaaccggcagcgccgccgacgatctgtgcggcccagtccgccagctccacccggttggcccggccggtcttggtgatcaggctcgcgacatgtttctcgacggtgcgcggcgacaggtgcagccggccggcgagcgcccggttgccgaggcgttcgacgagcagccggagcacctcgtactcccggacggtgacgccgagctcgcgcagttcccggggcacctcgtcggttccgctgcgacgctggttgaccgctgccccggcgcggcgcagcagcgaccggcaggcgctggcgaccgggaccacgtcgagccggtggaagtactcctcggcggtccgcaaccacggcaccgggtcgccccagcccccgtcgagcgcggcctccccggccagccgcaggcacaggtgccgggccatctcgtagggctcggccgcgatgagggcctcgtcgaccccggccgccgcctcccgcgcccggcgggcccggccctcggtcaccgcaccggcgagcagggcgaactgcctgttccagcggagcgcaccggcggccgatgggacgacgccgcggggctgtggccggccgggcccggagagcgccgcgagcagcgggccgatgccgtgcgcaccaccgaagtggccgctgacgttgccctcgccgccggcccggctgcgggcgagctccccgaccgcgcgctcccggtcctcttcgagcagcgcgcagaagacgcgggccagcccgtacacgcgcggcgcgtgcacctccgggtcaccgccccagcgccggaactcggcgatcgcgtcgttcatctcccggcgccgaccctggtgggcgccgaggatggcgcgggcgagcagcagcagctgggtggtctcgaacatcttgaggcgcatcgtgtcgcccagcgaccggtcgatcaggctgctcgcggccgggaagtcgccgcgcagcacggtgtgcagggcgaggttggtctcggcatggtacccggcggtgacggcgccgcaggccagcgcggcctgccgggtcttctccagggttgcggtgctgccgtcgcggagcgcctcgtcgtggcccagccggaccagtgcgtggatctcccagatcggcaggtcgtggcggaccgccagggcccgggagcgttccaggcacgcggtcgcctcggccgggtcgcgggcccgggtcagcgcgccgagcagctgccacgcctggcaggcgaccaccggcagcggccgggcctcggccaccgcggccgcgtgccgggtcatcgcctcggcgcgggcgaggttctccgcgccgggccggtcgacgaggacgtgggcctcgaccacgtcgatcgggacggtgtcctcgtccggcgcgcccgggccgagcgcggcgcgggcgagcgacacctggcgcaggccgtcgtcgacgcggccggcgacgttggccgcccaggcgagccgggtgtgcaggtcggcgcggcggcgtcggtcgcggctgtcgggcagctcgtcgaaacggtcggccatcccgagcgcgcgctccatctcccccgcctcggccagcgccgggaccagtgcctcgatgacctcggcctgcacggtccggtccggatggtcgtcgagcagttcacgggcccggtcgagcagccgcaccgccgaggaggcggcgccctgggccgccgcccggcggccggcttcgaggtagcagcgggcggcggcgcccggttcctgggcgcgcaggcgcagcgaggcggagaccaggcaccactcgcccggcaggccggggtaggcctgctcgaccgcggcggcggcgcgccgggccaggtcgacgcggtggccgggggtgagggtccgcagcagcgcttcgccgtgcagcggatgccggaaggcgtaccacccgggggtctgctcgtcggggaccagcagctggctggcgacctcgccgtgcagatggttgagcagcgtccggtcgtcgaggccggagacggcgcggaccaggccgagcgggaaacgcttgccgagcaccgcgccgatggagagcaggccgcgcgccgccgggtcgagttgctcgacccggcgggcgatggtgcgcaccagcgtgtccggcacggcgggccggatcgtctcggtcagccgccaggtgtcgccctcgcgaaccagctgcccactgtcgacggcggcgtccagcagttcctcgacgaacagcggggttccggtgctgttctcggtgagccggtcgatcaacggctgcggcaggtcgcccggggaacagcccagccgggacgcggccaggccgcgcacgcccccggcgtcgagcgggcccagtgtctcgatgacggcgctgccgcgctgttcggcggcgagcgccaggtcgagggccgggcagggttcgctgcgcacggtgcagagcagcacggtggcctggtggtcgaggttgtcggtgaggtattcgacgacggcgagggtttcggcgtcggcgtcctgcaggtcgtcgaggacgatcaggcagccccggtcccggccggcgagcgcggtgagccgcaggaccgcctcggcgagcaccatcagcgggacaccgcccgaggcggccgggccgtcggcccagtcggggatgagccggcccagggcgctgcggtaggggccgagctcggtgacgtcgaccgggtcgccgctgtgcaccagggacagcagcgcctcggtgagtgaccggaacggaacggtcagcccgaccatgctgccgcgcccacggagcaggcacatgtcggcggcgaaggccatgtcggcggcggccgccgcgaggcgggacttgccgatgccgcccgcgccgacgacgaacatgctgccgccgtgcccggcgcgggccctggacagcgtctgctgcacggtgtgcagttcctcgtcgcgtccggccaggtccggagtacggcggccgacgactgcgtcacgcgacgatcgtttcacgaggagtgattattcccatcccgcgcagacactgtccagggacgtgaaaccgactcagcgggggtccggcggggggcagcaggtggtgctggcgatcccgaacgcggtgaccacctcggcggcccgcgcctcggtccggccggtgtcggccacgcccacgccggccaccagaacgccggccaggaccgcggcctgcaccccgaaaggcactcgggccaccaggtcgagcagagtggatcgtgcgtcggtctcggtggtctcggtggcctgccggtcgtctcgcatggtgctcctcctcgtcgatccgtcgcgcgggcgcgcggcggtcatcctgtccacttgccggtccggcccggctcgagcagcaacaccgagggcacctgtgcggagaaccccaggcggagcagcccgtagccgatcccggccagtccgttgagcaacccgggtgtggcgacgccgtcgggcgcgccgcagccgggtccgtgccgttccagcgcgtcgagcaccaggccggcccgccagcgcaacacgcgctggacgaaccggtcggactcggccgccgccagtacgacgagcgcctcggtgacgcccagttcgccgtggcagaggctgagatcgcgcagcaccggccgccgggtgaaccgctgggcgaccgcggccgggtcgtcgcccgcgcggatcccccggatagccacgatgcccgcggtcccggtgcaccaaccgtggtcgtcgccggtttccggcagcggcagggcggcctagctagctagcggccaggcacccggcgatcccgccggccagtccgggcgggcagggcgcggcgaccgccgcggtggcggccgcgaccccgtagggaacgtcgtcggccagtgccggctcgtcgagcagcgcggcgagccgggtcaggccgtaacagatgccgccgaagccgtcgtagccaccggcgccgacgtggacggccagatcgggtcgtccggcgagggcccgcagcagcggaccggcggcgccggccgcgcgccgggcggtgtcccggtagcggctgaccccggtgaggccggcgagctgggccagaaagagggccacgccgaggtagccggtggccagaccggcgcccatcggcaggaccatccagcgggcgccgtcgacgatctccaggcccagccagttcacccggtcgccgtcggcgatgccccgggcgaggatctggtcggcgagcccgcacgcggcggtgagcagccggtcggggccggcctcggagccggcggccgggccggccaggaagccggcggcgcgatgcccgtcgaccggctgccgggtggccagcgtcgccgagacgatccattcctggtcccggcggtcggcggtgttcatgccggcgagcacggtggcggcggcgtcgagcccggtgccgggcagcaggccgggcagcggcgcgccggtcgaggaccatacgtcgcggcgcccgggcacggcggtgaagaccgggatgtcgccgcggcgcaggtcggccagctcgtgcggcaccagcggtccgggctcgtcggccagcagctccggatcggtggcccggtccagcagcgccgcgtacacggcggtcggccggaacaccacgcggaccggcagatcggcggccttgtcgagaagccgccggaagctctcccgcccggcgctgatggcgtcgtagccggcgcgcagcccggcgcgcagcgccgtgtcgtagtggcccgggtccagctcccgtccgtggagccggggcaggttgtgcccggcggcctcggccgggcggggtcgcagccggccgtcggccagctcccagtccgggccgtcggtggagtgcgtgcccaggcgaccggacagcccggaacagtcgacgacgccggccggaccgaccgtgatcatcggcagcagcccggtgcggtagaccgacgcggccagcatccgccgcgccgggtcggcacccaccgccgcgggcgcggagtccgggtggaacagcgcctcggcgtcgatcagcaccggatgctcgccgcaggcgatcaggttctcgtggtgcagatcgacggcccgcaccgcgtgcagcagggccagcagggcgccggcccggcgatagaaccgctccgcggccgccaggctgtccagcggcaggtgctcgatgaattcggcgtagccgtagccggcccgggtcaccgtcgccgcggtgcgcaggccgagaccgggcagcgcaccgtcgagccaggcggtcagttcggtcagcagcacgtacgcgtccaccccgcgcggcttgtagatgacgtgccgcccgtcggcgaaggtcagccgcgcgaccgtccggccgccctgatgcgggtcgcccagccccgcgcggacctcggtcagcggccccgggtccaccccaccgagcagcacccggaccaggtcggcccggtcggcggcgtaccggtgcagcagctccaccctggtccgcacggccgtgccgacggtgccgtgcagacgcccggccagccgcgggtggcgggccagcaggtcgtcgggaccgtcggccaggcgggccagcagggcggcgagccgctgcgggccaccggcgccggcccggtcgaactcggccgcgaccgtgctgccggcctgcctagccaggcgggtgccgagctcggcggcgaacccgtcggccagcgcgcccgcttcggcggcgggcacctcgcgcacctgcccggccagcaggtcacgggcgggggtgaccaggccacgcaggcacgcggcgagggcagccatcacgtcgtcggtcaccggctcggtcatgtccacgaccctgccagagtcaccggtcagcgacatgcgtagatgtcacccaggttttacccgggatcgccgccgtgcccagagaagaagcggcacccacgtgcgcgggcgtaccccgccggtcgttctctgccggacgccgggcacccgccgcgatgctgggccgatgtggaccccagtcgtgccggtcacggatgccgcagcgggatctgacctggccttgccctacgtcatgtcgccggcggcgcacatcccgccggccgcctgtcccgatgccctggacacgccggccatccgccgccggctgctcacccacggcgccgtgctgttgcgcggcttttccgtcgacggcgtcgacggcttcgaccgcgtcgtgcgcgcgatcggcggggaacccctggcctacaccgaacgatcgtccccgcgcagcacgatcaaggggcaggtgtacacctccacggactatccgccggaggaggagatcttcctgcacaacgagaactcgtaccaggcccggtggccgctgacgctgttcttctactgcgcgcagccgccggcgacccgcggggcgacgccgctcgccgacacccggacggtgctgcggttgatcgacccggcggtccgcgaggagttcaccgcccggggctggatggtggtccgcaacttcagcgacgactacggcgtgccctggcggcaggcgttcggcaccgaggaccgcgccgccgtcgaggcctactgcgcggccaacggcatggtgccggagtggacgggcggtaccggtctgcggacccgggcccggcgcgaggcggtccaccggcacccggtgaccggggaggcggtctggttcaaccatctgaccttcttccacgtcaccacgctggccccggacatcagcgaggcgctgcgcgagatgctggacgaggcggatctgccgaccaacacctactacggcgacggcgcgccgattcccgacgacgtggtggcccacctgcgggactgctatcggcgggcgctgcgccgcttcgactggcagcgggacgacgtgctggtggtcgacaacatgctggccgcacacgcccgggagccctacaccggggcacgccgcatcgcggtggcgatgaccgaggcctacgacgagcgctccggaggccaggcgtgacgaccactccggacaccctggtccaccatcccctgtcgtatccccagcagcagatctggttcctcgaccagctgcgcccgggcgccgcgatcgaccagctgctctcggccgcgctgcggttgcgcgggccgctggacgaggcggcgctggccggcgcgctgaccggcgtcgcggcccgccacgacgtgctgcgttcccgctacgagacggtcggggaccgggtcgtgcaggtgcccgggccggtcgccgacgtcgagctgtcggtcaccgacctcagcggcctgaccgccgccgagcgggaccgccggctgcacgagatccgggtcgccgagctgcgcgacccgatcgacctgcgccggcaggccccgtggcgggcgggactggtccggctcggcgaccgggacacggtcctgctgatcaccgtgcaccacatcgcgttcgacggcctgtcctggatccggttcgccgaggaactctccgtgctgtacgccgccggccggtgcggcgaggagccggttctgccttcggtcccccggcagtaccacgaggtggccccgggcggggacggccacgagcttgccggcctcgactactggcgggagcggctggccgggctgccaccgctggagctgcccaccgaccgggcccggccggccatctgggagcccggcggcgacagcgtcgaggtgaccgtgcccgccggtgtggcgcaggggttgcgccggatcggcagcacctgccgggccacgccgttcatggtgcacctggcggcgtaccagctgctgctggcccggctcagcggccgcggcgacatcgcggtcggcgtctcggtcaacacccgcaccggcgccgagcaggcgaacgtgatcggcatgttcgccaacaccgtggtgatgcgcacgacgatcgacccggccgacgatttccccgggctcgtggagcgggtccgccgggagaccctcggcgcgttcggtcaccagcacgtgccgttcgaccgggtggtggccgccgtcgcgccggcccgcgaccccgcccgcaacccgctgttccaggcggcgttccagctggccgggcgccgccggcagtcgttcgcgctggccgggctggccgtcgagacctgcccgccgatctgggtgggatcgccgttcgacctgtcgctgcacctggccgagaaccccgacgggtcgctgaccggccagctcgtctacgcgaccagcctgttcagccggacccgcgccgagcagatcgcggcggcctacctgcggctgctggccgggatcgccgagcgggacacccggccggtcggcgtcctgccgatcgtgcccgacgacgagctgcaccggttcgccgtgtggaacagcaccgcgctggagcggccgaccgagtccctgccggagctgttcctgcgccgggccgcggcgacccccgacgcggtggccgtgcgcggcgacgccggcgagctcacctacgccgagctggcgggccgggcccgcgcgctcgccggcgacctgcgccggcgcggagtgaccgccgaggtcccggtcggtgtcgccctggagcgcaccggcgacctcgccaccgccgtcctcgccgtgctgctggccggcggcgtctacgtgccgctgtcaccggagtatccggccgaccggctggcatacatgatcgccgattcgggcgccgcgctgatcctcacctcccgggccgtcgaggagcgcctgccggccggcctcccggtgctccggatggacggcgcacgcccggccgcgcccgagccggaactgcccgcgatcgccggcgaccaggcggcctacctggtctacacctccgggtcgaccgggcgacccaagggcgtcgtggtcacccacgccggtatccgcaaccgggtcctctggtcggtcgagcggtaccggatgaccgacgccgaccggctgctgcacaagaccacgatcggcttcgacgccgccgtgtgggagatcctggccccgctggtgtcgggcggctcggtggtgatggccccaccggagggccaccgggaccccgccgtcatgatcgacgcggtgatccgcggcggcgcgacgatgctgcaggtcgtgccgtcggtgctgcgtctgctggtcgccgacgcgcgcctggccgaatgcacttcgctgcgggtgatctgctccgccggggaggcgttgccggccgagctctgccggcggctgaccgggatcctgccggtcgaggtggtcaacacgtacgggccgaccgagtgctcgatcgacgccaccgcctggacctggtcgcccgccgaccgcacgccgacggtcccgatcggatcgccgctacccaacacccgggggtacgtggtggaccgcgacggcggactcgtcggcatcggggtccccggcgagctgcgtctgggcggcaccggcctggcccgcggctaccgcggccggcccgggctgaccgccgagcggttcagcccggacccgtacgcgggcatcccgggcgcgcgctggtaccacaccggtgacctggtgcgttggcgggcggacggcgccctggagttcctcggccgcaccgacgaccaggtgaaggtcaacggggtacgggtggagccggatgaggtgcgcgccgcgatcgaggagcaccccgaggtcgaggcggccacggtgatcgcccggcggacggaagcgggcgagacgctgctcaccgcgtacgtggtgccggctgtaccggccgacctgcgcgaccgcctcggggaccggctgccggccgcgatggtgccggccgggttcgtcgcgctcggcgcgctgccgctgaccgccaacggcaaggtcgaccgggcggcactgccggatccggccgcgacggacccggccaccccggccgggcgcgcgccgcggaccccgctcgagcacgagctgacccggatgacggccgaggtgctgggcgtcgagacggtcggggtcaccgacaacttcttcgcgctcggcgggcactcgatggtggcgatccggctggtgctgcgggtgcggcgggcgctgggcgtcgccctgtcggtgggtgacttcctggcccgcccgaccgtcgaggccctggccgcgtggctcgacgagaccgctgccccggacgccggggacaccgccgacgacccgcgggcgatccggccggtgccgcgcgaccggccgctgccgctctcccccggccagcagcggctctggttcctcgaccggctcaccccggactccgcggagtatctgatcccgctggcgctgcgggtgcggggcccgctcgacgccccgcggctgcgccgggcgctgcacgacgtcaccgcccgccacgaggtgctgcggacccgctacgccgagcgcgacggcgagccggtgcaggtgatcgacgagcccggcccgatcgccttcgaggaggtcgacctgtccggccgcccggacgccgagagcaccggcctcgatctgatcgaacgcgccgccgcccgccccttcgacctgacccgcgagcagccgctgcgggtcaccctgatccgggtcggtcacgaggaccacctgctgctcgtcctgctgcaccacatcgccttcgacgcctggtcgatgggcatcttcctgcgcgacctggaggccgcctgcaccgggcagctgccgccggccccgccgatccagtacgcggacctcgccgcgtggcagcacgaccacgccggcgacaccgccgggcagctggaacactggcgggaacggctcaccgggctcaccccggtggagctgatcaccgaccggccgcggggcgcgcagcgtgacccgagcggggcgatcctgcgcgtcgacgtacccgacgacctggcccgcaagctggtcgagctggccggcgcccgcgacgccaccccgttcatgctgctgctcgcggcgttccaggcgctgctcgcgcgctacaccgcaagcaccgacatcgcggtgggctcgccggtggccgggcgcacccggccggagaccgaggatctggtcggcttcctcaccaacaccctggtgctgcgggccgacctgagcggcgatccccggttcaccgcgctgctggcgcaggtccgggcgacggccctggacgcgtacgcccaccaggacgtgccgttcgagcagctggtcgacaccctgcagccggaccgggacctgtcgcgcaacccgctcttccagatcatgttcgacgtgcagcacctcgaccgtttcccggcgaccctgggcggcgcggcgatcgaggcgctgcgggcgggtgccgcggtggccaagttcgacctcacgctgaccgtccagcagcgggccggcgaccggctgcgctgcgtcttcgagtacgccaccgagctgttcgacgccgccaccgtcgaccggctggccggccactacctgcggctgctggccggtgtcgtggccgatccggacgtccggctcagcgaggtggacctgctcggcgagcaggatcggcggctgctgcggcagggtgcgccggccccgcgggaaccccgctgcgtgccccagctcttcgaggagcaggtcgcacgcaccccgtacgcgatcgcggccgtgcacggcgccgagaccctgacctacgcgcagctcaacgagcgggccaacgccttcgcccggtatctgcggggccgcggggtgaccccggagaccgcggtggcggtctgcctggagcgcggcctcgaggcggtgatcgcgctgctcggggtgctcaagtcgggtggtgtgtacgcgccgctggacccgggccacccggccgaccgcctggcgaccacgatcgccgacgcggacgcccggatcgtcgtcaccaccgcggagctcgccgcccggttcaccgcggacacctacgaggtggtgacacacttcgccgaccgcagcgagacgaacccgcggccggtcgcgggccccggcaacctggcgtacctgatctacacctcggggtcgaccggccgccccaaggccgtgatgatcgaccatcaggcgtacgcccaccactgccgggtgatcgccgaggcgtacgacatcacgccgcgcgaccgggtggtcctgctctccgcgctcaccttcgacgtggccatggaccagatcgcggcgacgctgctggccggtgcgacgatcgtggtcagcgacccggtcttctggccgccggccgagctgcccggcaagatcgcccggtacggcatcaccatcatggagatcaccccggcgtactaccgcgaggtgctggagtacgacgtcggcgagctgcgcgggctcaagctcatgaacgtgggcagtgacgtcgtcacggtcgccgacgcccggcgctggcacgagaccgggctgcccggccggttcctgtgcaactacgggccgaccgaggcgaccgtgacctgcctgctgcacccggtccggggggcgctccccggcgagcatccgtcggcggccctgccgatcggccggccggtggacggcacccgcgcctacgtgctcgaccgggatctgcggccgttgccggtcggggtgccgggcgagctgtgcctgggcggcatccggctggcccgcggctatcgcggccggcccgggctgaccgcggcccagttcgtgcccgacccgctgtccggcgagccgggggcccggctgtaccgcaccggcgacctggtccgcctgcgcgccgacggcacggtggagttcctcggccggatcgaccagcaggtcaagatccgcgggctgcggatggagctcggggagatcgaggcggccctggcccggcatcccggggtgcaggccgcggccgtgacggtcgtcgagctggtccccggcgacaagagcctggccgcgtacgtggtcggccggccgggcgccgagccgtccgccgacgagctgcgcgcgcacctgcaggcgctgctgccggagaacatggtcccggcgtggtggacgatgctgccggccctgccgctgaccgccagcaagaaggtggaccgcaaggcgctgcccgtcccggagccgctcggcgccgggccgaaacgcccaccccgcaaccccgccgagcggatcgtcgcggacatctggggcgaggtgctgcgctgcgagacggtcggcatcgacgacgacttcttcgccgtcggcgggcattcgctgctggccacccgggtgctggcccgcctgcagcaggccttcgccgtccggctcccgctgcgctgcctgttcgaggcgcggacggtcgccgccctggccgcggcggtcgaggcggcggtcgaggcggacatcgccgggctctccgacgcggaggtggccgacctgatggcccgcggttaggcgggacgcgtgctcctgctcgcgccggccgggccgaacgtcaggtcggcgccgagcaggagctgcgactgccaggccgggacggcggcccggatctcgtcgaggaacttgcgggtcgcctgctcggcgacctgcgcggcgacctggtgcagccccgggtgcggcgacaggatcgagaccgggaagtccttgctgatgccgccactgccgggcccggagtcgagcggcccgccgtgccggcacttgctcgccagcacgagcgggacgcggtcctcaccgccgtagtacccgctggtcagcttggtggtgatcaggatgccgcccagcgtgcaggtgttctccagaatgccggcgaccggcccgatcacccggccggggacgccgaggtccgggtcgggaccccggttgcccagctccacccagttggagtgggcgtagaagtcctggatcgggtgcagcgccgtaccgagacggccgcgggctgccgcgccgtcgcccgcggtcagggcggccagcagcgctgcccggttggccagcacgaacctctgacccccgtcgaagttctccccgtcgaagtgcttgtccgaggagacctggtcgtcgtcgaccgccttgtccgcggcgacgatctcctcgatcgcggcccgcatccgcggggtcggctcggccaccccgaaataggagccgagggcctgggtcaccgcgtgctcggtgatgctccggtgggtctgcacgccgagcgggatcgggctgggcacgaaggacaggtcgggagcgaaggcctgcgccggctcggccggcagtgccacctgagccgggaccaggccgatcagggtggcgcagagagccgtccgccaccggcgctttcgttggctgtcccgcatgggccgaaggtaggcggcgcgatgtcgcgctgtcccgggaatcgcccgatcaccctcggccggggacggcccggtggcggcgggcgccggtggggcgcagcctggaccggtggacgacatccgggagtacgcgcgctcgctgatcgcgacgaacctgtatctgaccctgggcaccgcggatgcggacggcctgccgtggacctcgccggtctatttcgcgccgggggacgcgctgcacgagttctactgggtgtcggcgaccgacgcccggcattcgctgaacctggccgtccggccgcaggccagcctggtcgtcttcgactcgacggtggagccgtaccgaggccgggcgctgtacgccgagggcaccaccgctccggcgacgaacctgaaccactatccccgcagcggggcacgggtgtccgccgaggacgtctcgggtgcctccccgtaccggatgtacctgctcaccgctaccgcgatgtgggtgttgtgcgcccgcgagccggggctgccgtgcgctctgcacggccgggccgaggatcaccgtactccggttccgctcggctgaccgcacccccgacggcgagcggtcacggcctgacgtacccggctcgactccgcctgacacaatgggtatcgatgaatgcctcatcgacggaaccgctgccaccgtggtggaagaaggtccatgacaccgcccaactgctggcctctcagctcaatgcggccgtgggacaggcctcccgggatggcgtctacaccccgccgccgggctcaccgccgccgcggcggcgccgacaggccgcctcgctgcgtcacctggccgaggtgatccgtacccatcgtcttgcccccggaatgtcggtcgacaaggacgacatcgcggcggtcctcgccggcgacccgcgccggatcaccgatccggtcctggtgatcgcggtcgcccgagccgcgcatcagatcgccgatctgcccttcaccgacgacgacgccgaccggctcagggtcgccagcgcccacgtcgcggcgctcaccgacgtggcacggcaggcggacgagaaggcgccgcgcaccgtgccggcgcgcctcaagcccgtagagcccccggtcatcgacgcgtacttcaccactcgccgaccccggaggcggtggccattggtggccaccgcctccggctcggtgctgctcgccggcatcggcacctttcttgtcctcggcgatcgcaagagcgagaaaccctcgccgccgtccgcaacggaaacccggccggcaccggtggccgccgacgccgagtgccggctgggcgccaccgacgacgacatcatcgcgaacaccccggcgctcttcgacgacgaccgggccacccggctcagtcccaccctcgacttcgaccagatgaacggctcggcccgctacgcccggcacgacggccggacctactactggggacgggccgggtccgacgaccaggatccgcacgccggcggtgcccgcatccggtggagcacccccgacggccgctggcgcagctgcgccagcgcgctggccacgacagagcggggttacgtccacacgccggcagtcgccaccaccatcggggggcagccgatcacggttcagatctgcctctggcgcgacgagccgcgccgggagaactgcacccagcagatctccaacggccgctgagccacccccgcagaccggacccggctggtcagggtcctccccggcgggcacgcgggatgcgttcgaaccctcggccagggcggtaggtgagcaggctgtggtcgcggcccgatcgcggacctcgccggcatccgcgccgccgtctggatcatcgccgcgctcatcggccacatccggcctggtggcctgtcaagtcgctcaccggcgcccgcggcccgagctaccgcgggagctgaccggggtgcgcgctcgtgccgcgcaccccggtgacagctctatccggccggcggccggaccacccgggagttgccggtcgagccgaacgccagcgaccccagcggcgcgggaacaccgggctgtggtgggccgagcaccgccagcgcctcgacccagtagcggaccatcgcccggctggtgctgtcctcacggctgactcccgcgtcgagccggcggcgcgcggccgccgggtcggacagcgccaggtcggcggcgaagaggtcgccccagacgctcgggcgggcacccagctcacgctggcgggcctcggacgggccgcggtagaacgagccggcggtcagcgggagcagctgaatgccgagaaccgactccggtttcgggtcgaaccaggtggcgtagtcgattttggcatcccagacgatcccggcggtggtgtgcgcgtatcccggcggccgggtcagcccggcgccgagccaatacatccgggccgtcgccgcctccatggcgtagtgggtgacgccgtacccggtcatcgccttgtcgccccggaccagcccccagcgggccaccgcctcccacgcggccaccgcctcgctcgacgactcctggttgttgccgtcggcgaacggcgcgaagcccgaggcggccgagctgcccagataggcgttgaaggcgcggaacgggggcagcccggacgccggcccgatcgcgagcgacccggcgtagtcacggacgatcaggtcgatcacgtcgccgtagtcgcgggcgaacagcggatcggccgacgccagcacggatgcggcgcggaccaggtagccgtactggaaatgatggtcgttgtagtcctgggcgccgaactcggccggcacggcgatcagcccgccccacgtcccgtcgtagccgaagtagcgcccgtcggacggcccggagcaggtcagccagtcgatcagtagcggccgcagccgggcgagcgccgccgtccgctccgccttcgcacccaccgctgccgccacctcggcgatggtggcgagccggccgagttccttgagcccgaagtagctgccgcccgcgccccccgggtccgccaggtcccgcccgaggtcgtcgcggaccgcgcggctcgccgccgcattcagcggcacctgcggcacggcggtcagcagccccggcatcggcacccgcacccgcaccgtgtcggcggagaccagcgacatcgtcccgcgagcgtccgggtaggaaccggccacggcggccggtccggccagcagcccgctctgctggtgcggcaacagcgcccacaccccggcgccgccgccggctcgccgggccgtgagggtctgggtgaccgtccccgccgcggcgtcgtagtccatcgccgccgtggtttgcaccaccggatcggcggtgctggcccgttcccagctcgcccggtcgctgccgtccggcacccgggcgacggccaggttctcaccggacccggtgaccgtggcgccgctgaggcccaggccgtcgccgatgacgtcccaccggccgccggcgatgtcgagccggacacgtgaggccgtgctccccacgtcccggaaggcgccggtcaggctgggcgtcgcgccctggaagcggagccagaccaccgggctgccctgcaccagggtggcgtcgaccgaccccccaccggccaggcccacgcgcagcacgacgtggaacgcgccgtagccggcgacctgcaccgccccggtcgcggcgccgacggtcagcgccggaagaaacggcgtcgtgacggcgttggcggaggccgtgaccggcgcgccgctgatctgcacgcccacgtcagcggctcgcaccgccagcggatgcgtccagatcggctgggtacgcggtccggtcagcgcggaactccaccactggttggtcgggaccgcccggccggcgagaccaccggcctggtccgggttcttcgtcggccggtccgcggccggcagggtatcggcgatgctgccgtcaccggacaccttgggcacgccgatcggagacgccgagacgtcctccatgaccgggccggcgtccggcgccggtgctcgaccggccggctcggcagagcaggcggccaccgtgacgagtgccgtcaccaccacggccgcggccaggacacgagggatcatgcgctgttcaccgccggggtggcaccgacggccgtggtggtgtccaccacggcgtggaaccggagtcccggcacgagcgtgcgcacggtcggcagggcggccgggtcgggccgcaacacgacggtgagcaggtcggagggcgcggtcgccccgccactgccgaccttgggctcgacctcttcgagcatggtggcgatccggccgggcagaccgggcccggagacgtaggcggtcatccccagccggagctcgcgcagcgtctcgagcggcacatcgacgcggaaggtgagctgggacgggtcgtacagggtgacgatcggttcgccggctcgggcgatctgccccggtgcgatgttgatctcggtgacgatgccggcagccggcgccttcagttgctgcacccgtggcccgccgccggcggcggtgtgggtgatcgtgacgacgggcgcgccggcggtcacgctgtcgcgatcggcgatcagcacccggttgacgaccgaggcgtcgggcgaacccacggtgatcggctgggcggccagcaccgccgtgccggcgtccagcatgttccgctcggcgtatcgttgccgcacgatgcgcgtgccgcccgcgacggccgacgccagcaggatcaggaccacggccagggtgcgcacgaatcgcagcacagcccgccaccgctttctcggcggggccggcgccggtccgggcggttcggcctcactcggtacgggatgggggtcgataccggtcttctcgatggtggtgctcatggtcaggcctctctcggagggtgtgtcgtctcgtcggtcgcgggccgcgacggcggagggatcgtggcgccgtcgagcccggcgtccggtcgccactggcgcgcgacgggacccggtcccgcgccgaatgacgaggagcaggtcaggcggtggccgggacgggctggggctcggagtcggactccaggccggtccgtggcgatgcgggcagctcccgggtcacgggcgggtgggtacccaccccgggcatggcgggcgtcgtgaaccggcggcggatgcggccgccggtgaccgactcgatgatcatccgaccgagaatgagcacgatcatgctcgcccagccgacggagagccaggtcggcgccggatcggccatcaccaggacaccgacgacgatggcggtggcgttcagcagcagcagggcgaccagcggcatgacggcccacagcgaccgcgcgtcgtcgccgccggcgttggtggccttccatttcgccggccggccgagcagcacgccgaccagcgctcgcaggtgcacgggaaccgcgccgatgctggccacgatcgcggacagcttgaacccgcccgactgcaaccaggtgaccaggagcacggcggcctggaacggcagatagtgggtggcccaggcgaagccgtcggcgcggatcgggctcagcgcgaagagcaggtagagcgacggaaagaacatgaaggtcagcatcgccagggacagcaggtagtgcgtgccgcagaagaggtactgcaggcgctggtcgatggtgaggccgctgccgcgtttgagcagccggccgcggagcagtacctcgaagccgccactggcccaccgcatctgctgcttgaggtaggacgggacgtcctgcggggcgaggcctcgggccagcacctggggcacgtagatcgacttccacccgcgcttgtgcagctcgatcgaggtccagatgtcctcggagttgctgcccgtccagatgccgccgatgccgtccagcgccgcccgccggaacatgacattcgtcccgacgcagaacgcggcgttgaagtggttcttgccggggcagaccagctcgtagaagatgcgctgggcctcgccggatccggtggcgaccaggttgacgttgttcgtgtacgactgtggggactgcacgaacgcgacatccgggtcctggaagtgcggcaggatgctgagcaggaagttgcgctcgggcacgtggtcggcgtcgaagatgacgacgaactcgccgtcggtacgggccagcccggcgttgacgttgccggccttggcgtgggccccacccggtcgccgcagatatccgatgccggcctgccccgcgatccgctgcaatgcgtcgctgtcgccgtcgtcgagcaggaaggtgcggtggggcaggtccatgtcgcgggcggcgaggacggtggcccgcaccagtgcgggatcctccccgtaggcggtcacgaacacgtcgatggccggcacgtcggcgccggcccgcagccggttgcgccagacgacgacatccaccggctccggctggtcgtcgtgggccaggatggtccaccatgtgccgaccaggtgcagggcggtcagaccctcggccgccagcatcgcgacccagagccaggtgggtccgcggtacgccgggttgagcaggaacagctggtagaagacggtcgcggcgagcgcggcgatgatcgcgacgcgcgtcgagcgctgcagcttccgccaggccaggcgcgtgcccggcccggccgacggtacggggggtgccgtcatgaatgctcccagatcttcggcattcagcaccgtggattcggtgccgccccctacaaaacagcaaaagtcgaagatgcgcgagcaccgtggccgcgtctggattggcgtcaatgtttcccggttgtagcttttccattgcgaccttggcatcggatttaatcgacaggcccacccaacgcactgagctgcggttgaccgtccggcccggttaaaaagaagtatccacgtcagcaacatccgatacgtcgagaagttgatcagtgagcgacgttacatcccgctggaaacggaatgatctcccccgaaacgtccccggaatgagaccgcgcctctcctgaaacacttgatgtcggccgaccgggacggatgccggatcattgaaggagatgaccgtggagcggcaccggtcaccggcgggcgcagcggcgtgcacggcgaggttcatgccgccgcggtccgcagccgcacccgggaggatgacgatcatgactcgggatcgacatcgtcgagtacgacccagacccgggacggcgcgtcggcgccaaccggatcctgcgctcgggggaaacgggcgccggaccggacacgacacccgggcacgccccttcgccggctccgtatggggttcgagtcgggcaaccctggagtaccgggcagtcggtgcacgaggtcgtcgtcgcggcggccacggtccgtacgcggcacgatgatcgggtgcgcgcacttccgccgatgggtgcgccgacctttgcccgatgcgaggcgggtaccctgccgaccggatattttattcaccgatagttgtcgtcggattcgccagtagtgcggccaaaggcgaaccgaatgcatacgcgcatggtgatcaccgacgagactgaggtgatctgaataaaatcgccagtgggcctgctccggcgacggcgggcattcgttccgaacggcgccaacgccctcaggaaatgggagccctcccacgcgaacatggcaaggttaatgaactataaggtgatcccggtagccggatcaccgacgttgacgatgcattacctggtgtgcagaatgtgaatcccgtttccggcgcgccgtcaagaggttgagatgttcgaggacactcccgtgactcccccaggcgatccttcgccggacaccggccggcgtgtcggcgcgacgccggcgccgcgacgggtggtgtcgggagacgtccgccaccggattcacctgtcccggcggtaccgcctcatcgccaccggcttggccgccggcgcggccggcatcgtgtccggcgtgtcgctcgtgggcctgttgcggccgaccacagatccggccgaggtgcacgccggtgcggcatccgtcgccgtcacgaatccaggctggtacccaccgaggccgcagatcccggtctccgtggagcccagccccacccgtgcttcgctccccccgtcacggcgaccaccggcgagcccggcgccgaccgctgttcccgccacggtcaccatcctcccggccgaccacgagagggatctgcgctcggtcgagtccgaccgggagaccgaaatcaggttcgtcaaccggcgcgacgagcccatcgtgatcaattggttggactaccggggaaaaagggagaattacggaattctcgccgccgggggcgtccgggaacaggtaacctacgtcaaccacccgtgggtgatcaccgacctgcggggccgggccctggcgatcctgctgcccgacacccgacccgctcaggcgacgatcacctgaacgcaacggggtttcgcaaccgtccttgtcggtcggtacgggcagggaccactttccgccggccgtcctttccttgagtgacgggttcgtcggggtgggccggccgaacttttcggcatcggcaaccgcggccctgtatgcggaggaattctctcggcattggtcgccgaggtctttccggaatgcgcaccagcgctgtcgggcgtacgcccacgatccgtagggtttcaccggctcggccgtcaccgtgaggaacgtcggctacaacggcgaccgccgcggccggggatcagcccgatccggcggcgcacccgctcacttctcgtgcggctcgaggtcgagcgcgttcagccagcggtcgagcgcctgcccggcatcggcgtcgacggcctcgctgagccacgcctgggcccgccgccaggccggtgcggcagtcgccagcgcccggtatccggcgtccgtgacggacacccgcgtggtccggcccgccgaggaggtcgccgccgcgtgcacgtatccacgctgggtcagcacgtcgaggttgcggctgatcgtcgagcgctccaggccgagccaaccggcgatctccgacggtcgcgccggcgcgccgtgcaacgccatctcggagaggacctccagttgggggtgggtcagaccgcactcccgcaactccgcctcgaaccgccgcgacaccagccggtgcagtcgtgcgatccgtctgcccagacaccggtccgccatcgccagcatctgctcgtgcgacccgggcgccgcctcctgttgcatatgcacctccagcctgtatcgtagccccccgaccgatgttgcagatacaacaatggagttcccatggtcccgctcagcgagctgctgcgccgcaaccgccacttcgccgcccacgccgacctgaccagactcaccctgcccacagccctgcccgaccggctgctcctgatcctcacctgcctggacccgcgcgtcgaaccggccggcttcctgggcctgggccccggcgaagccgcggtcctgcgcaacgccgggggccgcgtcgacgagcgggtgacgcaggacatcgcgctgctggccctgcgcttcggcgtccggatggacgtggcgatcatccaacacacccagtgcggaaccggcctgctggccgatcccgcgttccggcgcgacgtcgccgaccgcaccggggccggcgacgccgagctgaccgcgaaggcggtgaccgacccggtcgccaccgtgcgacaggacgtcgccaggctgctcgctcatcctctggcggcggacggcctcgtcgtcagcgtctccggtcacgcgttccggctggagacggggctcgtcgaaacggtcgtcgacgccgttgcgccggccgggcgccacgcagcgtaaccgcccgcgccgcagccggccgggggatgccatcccggtgtgcggcgtccgcggacggccgcggacgccgcacaccggaccgtctcgccggccggtacggcaatgcgtgccccgtcgaccctcagcagccgttgcgagccgaagacaccgcgacgtcgtcgtaccagagggtgtcagcgccctcgccataggcttcccagcccagccgcaggtcggtcagggccggccgccacgtccggtcgagccactgaccgtcgacgtcgtgggtcgccacgccgtcctccagcaggccgggcaccgaggtgccgttgagccaggtctcgatcgtgccggtcgagccgtcgaccttgaactcgacgcagttccaggtgccggtcggcagcgcccgggacagcgccaccccggccgggctctgctcgggcagcgtcgcgtcgtcggaggcccggttgaactgcagcgccccgttctgcccgccgaaccgcagatcccggccgccgtcattggcgtcggccatcgccaccgcggtgacgtgcgcggccggcagcgcggtggtgtgccgcacccagtaacggacataccagacgttgccggtcccggcgagcagactggtgttgcgggcgaacacgtggttgcagtatccggcggcgccgttgatccgcaacgaggcggtgccggagtgcgccaccgtcgtgtcgatcgcggcggtgcccgccccggaacagtcctgggtggtcaccgtccagttcgccagcttgttctcgaagccgtcacaacgggtgccgcaggtgccgggaacggtcgacgtggacgccgacggtgtgaccggcggcgtcggttccgccccgcaggtcaccccgttgaagcggaaggtcgacggcgcggtgttggtcccggagtaggtgccctggaagccgaacgacgtggtcgccccggtgggcaggggcccgttccagccgacgctggccgcggtcaccgtcgtcccggactgggtgacggtcgcgttccaggccgaggtgaccttctggccgccggcgaaatcccagcccagcgtccacgaggtgaccgccgcgccgaggttggtgaccttcacgtcggcggtgaacccggtgctccacgagttcgccgtccaggtcacgtcacaggtcgatgctgccgcccgggccggaccccggccggcgacgcccacggcggcgccggccaggatcacgacagcggcgagggccgcatgtttcacgagcaggccacgccgttgagtttcacggtggccggagcactggccgtaccgttggcggtgaaaccaaccgagaccgaggcgcccgccgcgagcgacgacgcgtagctcggcgcggccgcggtgaccgtggtcccgctctggacgacggtcgcgttccagccgttgaccagggtcaccccggacggccaggtccaggtgacctgccacgggctgaccgtgccggtgccggtgttctgcaccttgacctgcccctggaagccgccctgccaggcgttgtcctgggtgtacgtgaccttgcacgaccagccgggcaccggcgtcgacgaggacgacgaggcggacggggacggcgagccggtgcccccgttgccgccaccgatcggcgcgatcaggtacggctgcaggatcgcctgcttggcctggttgatcgtggtccagtcgtcgttggcgatgccgccggtgtcgcccgagttcgggttccacgaccagtaggtgaacgacatcccgttcaccccggtgccggtgtacttcagcagctcttgcagccagatcctgtcgatggtgctggccagcgtggtgccgaactcacccatcatgatcggggcgaggttctgcttgtacaggtagccccagtagtggtcccagatggccggcatgttcgccgggtacgacgggtcgtcgaaccacgcctggtggtagaccgacgtcgcgtattcgtgcggggagtagaccagccggttcgccacactgagccggaccgggaaatcccccgccttggacaggttgccgccccaccagccgcagtcctcgtcgttgccggggtcgttgtcccacacgttggagagtccgccactcgggcagctgaccccctccacgaagatcagccagttcggctggacgccgaggatcgcgttgccggcccgctcggccgccagccgccagtcgcgggccgtgtccccgcagccccagcaggcgccggtcgcggccgggttggtgccctccgcgtgcggctcgttgtgcaggtcggcgccgatcacggtggggttgcccgcgtaccgctgggccaggctcttccaatcggcgatccaggtggtctccggcacggcggcggtgtaccagagcgcggtctgcccggccgaggtcggccggtgccggtccaggatgatccgcatccccttggtcccggcgtacgccacgaccctgtccaggatctgcagcggtgacagccccaccaggtccgggttggtgttgtcgttgatcccggtcgcggtcgccccggccttgagcgagtcgtcggagaacggcacccgcagcgtgttgtagcccagcgaggccatcgtgtcgatctggctcttccacgggttgctggaccacagcccgtggaaggtcttgttgtcggtctccatgccgaaccagttgatcccggtcagccggacggtggcgcccgtgctgtccacgatcttgttgccgctggtgtgcaggtagccggtcccggtaccgccgccggcggcgacggccggttgcgcggtgacgaccgcagccatcgccgccgcggccgccagcgctgtcgcgccggccagccacattcgggtcttcatgtgggagctccttcgaggacggaaggcatgaaacatcatggtgacatgggagcgctcccacaacaatgcctgtcaatgtctttcaggaaaccgatttctcggtacgcggttgatcacggctcgaggcgcgaatcccgctgccagccgtgtcgatccgatcgagggccaggtcggcgttctccccaggcgccgggatcactcgtgggcccggtggagctggcgcgacgactgagatccccattcggcgacctgccgaaggcgggattgctgatggtccttccgggcccgcagatggccggtgcgtgattccacttttactcggtactccccgaagccgatcgcttgaggtgtccgcacgcaccacccctgaggcatcctaggaagataggaaagcgtcctcgacgaggaacgcttcccgaccgggcggacggggcgaccgggccgcttcgcgatcttcgcgccgggtaggctccggatcgacggccgaatcgtgacgggcggcgcggggatgtcgcccactggccgccgggatactgcggagggcgagtctgatggatctgtacgggaccgaacccgagggtgtcgaatccgagggcatgggcgccgcgccgtcggtggcgaaactgcttctggagctccgcggccggaccaccgtcgacgtcaagccggtcggtcgcagcatccagatccgcccgcagggcgcgcggaacgtggcggtgcacatccacccgggcggggtcgacatcgcggtggcccgcaaccaggccgacgaggtcgcggcgacgatcttcggagcgacggtgaaggatccggacgacccggtgccgttcgtgtcggtcgagggtcatctgatcgacaccaactacgacgccatcctggccgcctcggtgcaggccgtcgagctgcgcaaggccggcggcccggcgaaggcgccgcgcgccgcggcgagtggcggctccggcacgccccgcgccgcctcgacccgctcggcggcaccgaaggcgaccaaatcgacccggcccgcgccgcgccccgaccggccgatctgcccgcgctgtaagcagtacgagctgctggccagcggcgagtgcccgtccggttactgctgagccgcctcagcggaagccggcgcccaccgacccctggtcccgccgcatccggcgggccagggccgcgggcggcagcccggcgaactccaccgtctcccggctcagatgcgcctgatcggtgtacccggcgcgcaccgccagctccccggcgctcccctcccccaccatcgccagataccgccggaaccggtagatccgctgcagcgtcttcggtccgtacccgaccgccgccgtgaaccgccgccgcagctgccgatcgctgagcccgacctcaactgccacctcatccacccggatccgcggatcgcgcagcatccgggccgccgccagcatcgccggatccaccgggttctcccgggccagccgcccggtcgccacgatcagccggcgcagcgcctcccccgcccgcacctccgccggcaccaccagcccgggaacgacctcgccgagcccgggccgcaggttctgcaacggttccagcggcatcccgagcaccgtccccccggccccgggccgcagccgcaccccgacgatctcccgcccggcacgtccctcgttcggcaccggccgggtgtccgggccggccaggaacgccccgtgcccgctctgccagatcaggtccacgcacccgtccggcaggatcggcatcggcacccggctcggccgctccggcagcgtgctgcgccacaggcaggccaccaccccacgcagcgacggcggcggcgcccactcgatgtagcccatggccgattcatacaagacccggccccgcgccgcacctagggtcgaccccatgagcgctgatttcgccgccgccgaccgtttccttcaggccgagggtcgccttctcgaccgccgcctgttcgccaccctgttccggggcgcgtccccggacggcgtggtcgacgccctgcgcggctaccgcaacgccgacggcggtttcgggcacggcctggagccggacaagcgctgtccggccagcctcccgatcgacgtcgaggtcgccttccaggccctggccgccgccggggtcgccgacccgggcctgctcggcccggcgtgcgacttcctgaccaccgtgacgaaggacggcgccgtcccgctggcgttcccggtcatcgaggaccatccgcgggccgcccactggaccgactggacctacgagccgggcgtcaatcccaccgccggcctcgccggtctgctgcaccagctcggcttcgcccacccgtggctcgacaccgccaccagctactgctggaccgtgatcgagtcgggccgccttccggaggagacgcacgcactctccgagctgctcgtcttcctcacccacgtgcccgaccggccccgcgccgagcgcagcgccgagagcgtgctggccgcgatcaccggttcggagctctttcagaccgaaccccggatcggcgcgtacgggttgaccccactgcacgtggctcccaccgccggctcgccgtggcgggccctgttcgaggacgcgcagctcgacgcccacctggaggctctggccgcggcccagcaggacgacggcggctggccggtcacctgggagccgccgagcgcggcggccctcctggactggcgcggccacgtgaccctgcaggcggtgcgcacgctgacctcgtacgggaaaccggggtagaaagcgaccggacgtggacgtgcgcgatcgggcccgggccgggaagatgggtctgatgcacgcgccgatgggggccgttcgccggctgatggatctgcgacaccgggggcgagccgaggatctgcccggggtcctcacggccgccgcgccgctgctcgacgcccgggcggcgatcgtgctgctggtcgactacgcgcagcgtgagctgcatccgctgcgcgggacgacgccggtggcgccacaggcggtggagggcaccccggcggggcgggcgttcaccaccggtgatcagcagtggtcaccggagccggacggtggcggcgtgctgtggctgccgctgctgcacggggcggagcggctgggtgtgctggcgttgcggttcacgacgtaccccgtcatcgatcttcgcgacgatctggaggtgatcgcggcgctggtggcggagctgatcgcgagccggcggttctacggtgacgcggtggagcagacccggcggcggctgccgatgcagctggccgccgaggtgatctggaaccagttgccgccgctgacctatgcgatcgacgggaccacggtcaccgcggtcctcgaaccctgctacgacgtgggcggagacgcgttcgactacgcggccaacggcgagaccctgcacgtggcgctcttcgacacggtcgggcacgggatcagcgcgagcgcgctgaccacgctcaccctcaacacgtaccgtaatgcccgtcggtccggcctgtcgctggtggacacgtgccggtcgatcgacaagtggatccgcgcgcagtatccgggggcgttcgtcaccgcgctgctcgccgagctcgacctggcgtccggggtgtaccggcggatcagcgccggtcatccggccgagctgttcttccgcggtgatcggagccggtcaccgctaccgtcgccgaacacactgccgctcggcctggggcacatgctcacccggccgccgcgggtggtggagcagcggctggagccgggtgacacgctggtcttctacaccgacgggatcaccgaggcgcgcgacgcgtccggcgtgctgttcggggtggaccggctgaccgcgttcttcgaggacgcactgcgacaccgccggccggcgccggagacgatgcgccggctgatccacaccatcgtgtcgtacgaggaggaggagctccgcgacgacgcgaccgcggcgatgctgcgctggcggactacgtgaaagccacaccaccgagcatgtagacgtcggcgtcgctgaccgcgcggtcctcgtcggccggatgccagtggtgcaccgggacgacacccggctcgaccaggtcgaagccggcgaacaggcgctcgaccgcggcacgcgggcgggcgacgaccggcacaccgttctggttgtacgtccggacggtgccctcaccggccgcgtcgttgtcgacggtgaccaccgacagggccaccgcgctgcccgccggcagcggtgcggtcagctgggccaggatgtcgcggacctgatcgtcatcggtcacatgctgcaggacggcgattagcgtgacggccaccggccggttcaggtcgaatccgtcccggacggccgccgaccccaggatcgtgtccggccggcgcaggtcggcgtccaggtaggagacgctgccggtgccgatcggggtgagcagggcacgggcgtgcgccagcaccagcgggtcgttgtcgacgtagacgatcgacgcttccggagcctcggtctgcaccacctcgtgcaggttgggccgggtcggcagcccggtgccgacgtcgaggaactgccggatgccgcgcccggccaggtagcgcccgacccgggccatccaccgccggttggccgccatcgagatcggcagcgccggcgtgtgctccagcatctgcgccgcggcccgccggtccgcctcgaagttgtccttgccccccagcaggaagtcgtagatccgcgccgagtgcggccgatccgtctgaagatcaccgggcaccatgacaactcctcgaaaccggtcagtgaggccgaaacacgccaccgcatcctaaggtgacgcccggcaccccgcctaccctccgtacagctggtgccgtgaccaccgacatttccggccgaggctgcatacctacctgcgccggcgcaacccaacgcacgccacccgacggccgaacagcacttttacacctaattctggcgttacggtaatatttaacaagtagtgctggcactctcggcactatggcgcatcgccgttcgcgaaccgaccccgtgctgggcgccgtcacgatcgccgtacgtccggagaccgatccggcactgtgggtcctgctggaccgctacccgatcggctcaacggggcaaccgcaggcactcgtcggcgacctgatgacccagacgaggctgaacatgccgggcacgtttgtgcacgagtgggcgcatgtcctccaggcggccgcgtacccgatgctgtatctacgagcctcacgcgaatggcggatggtccggacgacatggaattatctcgccgcgcatcccgggcgctatccgctgcccatagggatccagtgggacgccgacatacgccgtgcacgacaggtggagactgctccggcgcggatcgagatacgcggacgcagtgttcaggtcgtgccggcgagtttcgacaaattcgagcggggcgtgctcgtcgacaacgacctcctggaggaggatgcgagcattttccaataccgtgtggagcgcggcggctggggaagcggaaccgactaccagcggtgggtgaacgaacgctgcagttactcggcggtcttctccttcctgcgtcgatacctgccgatcgatacggcgtacgcgctcattcccatcgccgcacgcgtcgcttaccgcaccaccgacccgctcaccgctttggccatcatggtggggtcctctctgcacgaaggcgacaaacacatcgacgaggagaacgaggatttctgggaattcctcatggccatgtccgtcgaccgccttctgtcgccggctgccgacgaggcggtcggctggactcgtcacgcggatgtcgacgcggcgctgatcaccagtcagcagatgcgccgggcggttgacgccggcagcttcctgccgatcaaccacctcgcgcgccgcaatgtctccgacgccagtgtcgagaaagtgctgcgccgcccctgggagcacatcgcgccgaacgggggtgccgacgagtgcgccacctcgttgttgccgccggcgactgtcttcgaactcgccgatccggcacggttggcaatcagtctccaccgctccttcgcccagctgcacccggtggcgggtgcggagttcacgttcgctgatgtgtacccgacgatgctccagcagaaattgatgttcgacgtgcaggtggggggtcgcagtgcgcttcgcgtctgtccgcaccagacctgccgtgtccacggcaccgatctgtgtgaagggtacttcccggtgccgcgtgaaccggaggactgcggcttcccagatctgttccgcatgctgaccggcatgaccgtctcgtcagacggcgccaccttggaacccgtccaggaaggatgagcgcatggaacttctcatcgagggtgacccgcagacactccacattctgcgacgggagatcgacgaccggatcggcgccgcggcagagctcgagccccggtacgaccggacggtgggcaccctcaacgaaccgattctgattgctctcatcgtggcactcggcggcaaggagatcatcctcgccgtccgcgacatcatcaaccgacgctacgaacacctggagcggatcgaggcgaccaggtacgccgccgatctgacattgactcttcgcgaccagaggggcgaccgcgtagtcagcgtcgacgagctgatcggggaggcgcgcgatgggcagccgtctgccgacatacgaccgtaggcaggtgtacgtggaggtcgatcccgatactgcccacgatccgagtaggctcgcctggcacttccggagcgcgtcgctcgcgacggccgactgggccggatgtacggtattcatcttccccgacctcgagcgggaggacctgccgatattcctggacgagcgggtccggacgttctaccgcaaactctgtgacgacgtcccgtttctcctctatttcctcgatccggaaccgggcacgggaactctgctcagcgtgctgtgcgcccatgcccgcgacgaccagatcgctcagcgccacggcatggtcgagatcgatccggacgaacgactgcgcgaccggtgcgcccggctggtcgccgacgccgcggtctacgccgatcggctgggtgacgattggccggcgttcgtcgacgaactgcctctcccggacgacttccgcacccgggcgctgaggatgtgccaaggtcgcattccctgagcgcgcacgccggccgtcgccgtccggcagcatctgtgccgacaccccaaacgcgcgtggtcaaggcgctagagtgcgccgatgggtttcttcgggacggtgatgctcatccgggcggatgtggacctcgagacgttgcccgccgtcgtcgcgctcggcggcacgctggacgccgcctggaccggggagcacggctggcggttcgcccgggtgtacgacgggaagtcgttcctgccggccggggtccgtgccgtcgccgagcagaccggcgcgccgttcctggccgcctacgtcgtggacagcgacttcgcgatcgtccagtgtgccgccccgagcctgccggagatccagttcgtgctcaacccggcgtgcgccgcggactacgactacccggtcgacccggcggtccaggaggccgcggtgcgctacctcctggacttcgccggcgggcggggtgacgcggcccggatccgggccgtggtcgaggacgatctgacgttcgccgaggaagcggtgccgcggctggcggccgcgctgggggccggatccgtcgaggatcccgaccggtagtgcccggtgaattccgggcggtcgacagcgacctggtcggtcccgccgatggcagcgggccctgctactcagtggccgaggccgccgacccccttggcgatcaccagcaccgagatgaccagagcggacgtcgactcgatgcccatcaggatcttcgcccgggtggacagcggcatggtgtcggtcgggctgaacgccgacgagttgctcaacgacacgtacaggtaatcgacgatggccggcacccagtcgctgaccttgctggaacccgcctgcacctcgtcgatcgtgtcatggtcctcgtcctgcgggaaccggaagtcggcccggggcagccggtcacgcgcgacgtgggtccgcgcgaccggtccgccgcggtccagctcccagaacgcgagcccgtagacgatcacattggtcagccacacctgcccggcggcgatcagcaactccaccgactgcgagtcgtcggtggtgaccagctggcgcagcagcagcaccagggcgaccgcgttggccaccgcgatcagcgcgaccagggtcagcgcggcgacccgctcccacggactgtcccgggtcatccggtacggattgaccaccagcaacgcgatcagcagcatcacttcgagggccgggatcaccaggcgcggcccgatgatcagctgctccggcagcagcgcgtagagggcgatcgccaccacgaccaccgcggcggacggcagccgcgcttccccgcggcgggctttgacggtatcgggcatcgccgcgaggtgccccagccgctggaaaatcaaacaagcggtgatcggaagggcccccatccttgtgcccccgcctggtgatcctcgacatgactccgctcgacttcggtcgaatctcccgacgtctccccgcctcccactgatcgtcgacgttgtcgagcaggtggcgcaggggcgacgcgggcgctgcaggaaggaccggaagtgaccacggaacgaaacttcgccgacgccgaaaccttgactccggtgatgcgggaggtcttcggcacccgccgccggatcaccgccgtcgaccgcctaccgaacggcaccaagacgggcgtctaccgcgtcaccatggacgacttgacgagcgcgatcgcctatatctggaacgccgaagaggactactgggacgggctgctcacggacggccacgacgacccctcgaaccctttcgcccacgcacctcggttacgtggcgaggtgacctgctgatcggtcaggcgagcgcgagtgcgtcgatctccacccgaaatgcgggattgatcaatgccgcgacctgcaccaacgaacttgccggcagggccgccccgtccaggtactcgtcgcgaacctcccggaagacatccaggtcggccatgtcggtgaggaagacggtcaacttgacgatccgctcgaagcctgagcctgccgcggcgagagcgacaccgagattgtggaacacctgacgcatctgttgcgcgggatcgtcgaggccgaccaactggccgttcccgtcaagcgggacctgacctgacacggcgaccatggtgcccgagaacgcgacgacatggctgtacccattgaccggaggcaggcccgcaggccgctcgaaacgctgcatcgggacaccctacggtcccgcttgcccgaccgatgtccccggacatcacacctaggcgcgcatcaccgtggcgatcgggatgccggccgcccggatcgccgggatgaagccgccgaggatgccggccgccaggccggcgatgatccccgagacgccggccgaccaggggaacaccacggattgcaggaacggctcggacggcccgaggacgatcgtgcccaccttgagcgccgcgatgctgaagccgatcgcgagtgctgcggtgagcaggccggtgagcagggtttcggcgaggacgatgccggccagcacggcccgcggtgtgccgacggcgcggcgcagggcgaattcctcgacgcgttcgccgacggtggccaggccgacgttgaggacaccggccgcgccgatgatcaggaccagggacgccatcgccaggaagatcatccggagcaggttgagctgttccttcatctccttgcgggagttgatcgtctcagcggtcacgtcgttgccactgagggctttgagtttggtgagcaggaccggttcgaccggggtggccgcggccagcagcacctggctgtcgacgttgccgccgttcgggtcggacagtctggccagcggcagccagctggtcagctcgtcaagacgtacataggcatggggttgtgaatctccgtccttgatcacgccgaggatccggggtgtcatgttggccgtggcaccgctgactcgcatctcggcgggcacgtggtagcggtcgaggcctttggcggcctcctcgttgaggaccaggccgggggcgagcatcggctggctggtgaagtcgagccagcgcccggagcggtgccgatagggccggaaggtgcgcacgtcgccggtcagcgcgctgatccgcaactcgatcgcctgccccttgggggcgcccgcgttcgggtcgtagcagtgtgtcggcgtgtcgcagatggtcaccgcgccgccaccgctgtagtcctggtcgaaggagccgccgccctcgttgaccggccggacgccgggctcgccgatgatcgcggtgacgttgaacatggcgaccgcgtcggtgcgccccttgaccgtcgaggcgaccgcttcggcagcgcccgcggccggcggcaccccgtagatgaccttggtgccgtcgatgccggactgcagctccaggtcggccagctgcaggcgttcggcgatgccggcgccggcctgcaccaccaccacggccagcacgccgaggaagagactcaccatggacagcagggtgcgcagcttacgggcgcggatgccctgcaggccgatgatcgtcgccgagcgcagccggccgttgaaacgcctcacgtcaaaacccgatcattgagtacgccgttgcgcaggtccagggtccgtcccatccgtgccgcgtggtcccggtcgtgggtgaccaggatcagcgcgcagccccggccggtcgcctcctgcagcgcgtcgatcacgatggtgccggtctccaggtcgagcgccccggtcggctcgtcggccagcagcacccggggttcgcggaccagggcccgggcgatcgccacccgctgctgttcgccgccggacatcttggccggccggttcttcgccaggtgcgcgatgccgacctgctcgagggcctgcatcacccgggctcggcgttcccggcggggctgccagccctgcccgttgaccagcgccatcgccacgttctgcgccgcggtcaggtgcttgagcaggaagaagcgctgaaacacgaagccgtagtgggagctgcgcagccgggcggcgtgccgttctttgaggcggctgatgtcctggccgtcgagcaggtaggtgccggagtccggccggtcgaacaggcccagcacgctgagcagggtgctcttgccggagccggagcggccgacgatggccacgctctcgccgggatggacggtcaggtcgacgccgtccaggatggtccgcggctccttctggcccttgaggaccttggtgatcccggtcagttcgatcagcgcggtcatccgttggtcccgccgccggtcggtgccaccgtgggcaggttcggcccgggcacggcgaccgtctcgtcgccggtcagccccttcttgatctcgatcaccttgccgtccgagatgcccagcgtgacgtcgatcgtcttgcgcgtctgcccgtcgccgacgaccaggtcgaccttgccccggccctgcgcgccggcgaccgcctcgaccggcagcacgagcaccttgctcgcccggtcggtgaccacctcgatggtcacgtcggcgccgttgatcagcttgacgccggccggtggcacgcagaccaggcgcatcccggtcgcctcggacccgccggtggcgccgccggcggtgccccggtcgggcgcggccggggcggacgggttctgcgcggccggggtggtggcggcgacgaccggctccggcaccgtgcctagctagctagcggcgacgaccggctccggcaccgtgcccgccggcagcgccgcgatggtcccgagggtggtacaggtgaacgggccgggaccgttcttgatctgcgcctgcacccggctgatcgccccggacacccggtaggcctgcgcgctgtcgatgtcggccacgatcccgtacccggagtgggtcgccgagatgaccggcatgcccttggtgacctgggcgtggtcgtccatcagccggcccgcgaagaccgacccgaccgggatctccacgtgctgcgggtagccgtcgtgccacacgctggccacccagagcgggttcttggccggcgtccggggcggggtccggccggggaaccgcaactccccgtcgaccggcgcgaccaggccgaagaccgggttgatcgtcaccttgccggccaggctgagccggttcgccagatcctgccggacgggtttgaccgtggtcaggaccgtgccacggtcggcgagcccgggggtttcggcggtatcgtgcgaggcggagcagcctccggccgccaggaccaccaccaggcccaggagggcatgcctgcgaagaaccaccgaatcccccgtcgtcaatgcattcaacagcgcggcgaagggtaccggaccggcgcaaccccggcagccggctgccatcatggtcggatgatgctcctggtccccggggatccggtgcggccgcggcgacccgacgggcacttcgcggccgaggccgccgccgcgccggcgttcgccgtggtcgaccacgacgcactggccgcgggcggcgacgcggacgcggcggtgagccgggtgccggccgcggcggacgctgtctatcgcgggtggatgctgagcgccccgcactatgcggcgatggcggcggcgctgtgccggcgcggggtgacactgcgcacgagccccggcgactaccagcgggcccacgagctgcccggctggtacgcggtggtcgccgggcacaccccggagacggtgtggaccgacgctgacatcgccccggcctgcgcggcgctgggtggcggcgcggcggtgctgcgcgactacacgaagtcgatgaagcattactggcacgaggcggcgtacgtcccggacgtgaccgacgtcgaggccgcgcgccgggtcgccgcccgcttccgcgagctgcgcgacgacgcgttcaccggcggcctggtgctgcgccgcttcgagccgttccgcggcgccgaggtgcgcacctggtggctgcgcggttcctgccgcctggtcaccgcacacccggacaccccggacgagctgccgccggacgacctcgacccgggtttcctggcgccggcgatgcgcacgctggctctgccgttcgtcaccgccgacctggcccgccacgccgacggtcgctggcgtctcgtcgaaatcggcgacggccaggtcagcgaccgccccgccaccacgccgccggcccgtctgatcgacctcctcgcgaccgcgtcatgagcgaataccgtgccgaggacatcgtggttctggagttcccggaggcggtccagcggcggcccgggatgtacttcggagtcggtcggggcgatccacgactgccgtccgaggtggtgcgcaccgtcgccggcgccgcgttccaccccgcaccgcccggcgtcgagcatcgaccggacgtcgtcgtggagatcctcggcgatctggtgttctccgtgaccgtccgatcggtcaccgcgctgcccgacggcaccgcccgcggctgtcaaggatgcctgctcaccgcgccactgatgtggtgggcggcggccgccgcggtcagcgtctcggccgtggtcgagacctgggcggacggtcgtgcgctccgcgaggaactccgccacggccggccggccggaccgccgcagccccggccggcgccggagggacgggggctgcgggtcacgtaccacctggacccggagctgctcgcgcccggcgcggcgatcgccaccgaaccggcttccctggacccttacggcccgtactgcgccgcgcaccgcggccccggtcaggtgaccctccacgaccggcgtgccccgggaactccggcggtccgatggcccggcgaccggtcagcgataggtctggcggctgaccaggacggcgacgatggtgaccagcagcagggcgaacgggaggcggccgcgggcgcgcagcgggatgttcacgccggcgaacatggcggtcaggacgagcatggtggtcgcgccgagccggatcgcgaagctgccgtagtcctcggtgatccggggatcgccggtgatccagcccgcccgcgcggcgacggcgtagcccgcgaggtagaggaacggccagcccaggccggcgagggcgccgacgatggtattgccggccaggtaaagaaggcgtgagatcaccggcgcgacgttaggtggcgcggagcgggccggcggcttccggcgtggacagtggcatgaaatgggggtctcgccagccgacgcgccgcggtacggacggctcagtcggccggggccgagtagcgggcgcggatgaaggcgccgaggcgggcggcgaaggactccagggtgggtgcggcggcgtgccgggagtcccagacggcggcgaggcggatgctcaggcgccggccgccgacgtcgaccgggagcgggaccaggccgaagcgcgggtcgtcggaggcgacggcaaccccacgccccgcggcggccagtgcctgggcgaccgtgccgttcgcggtttcgatgctgctggtgtacgtcgcgcccgccgcggccacggccgactccagcgattgccgggcggtgaaggcgggcggttgcacgatcagcgtcgcggtgagcaactcggtgagcgtgacggccggccggcccgaccacgggtgatccgtggtgacgtacgcccagaccggcaggaccgcgagcggcagcgaccggaagggatcagcggcccggaccgtgccgatggcgaggtcggcgccgagccgcaacgtctcgaccggtgacagtccgtcagcgtcgaggacgtcggcgttggggtcctcgggggccagcgtggcgatgaacggcgagacgacgtcggtgagcgtgacggtgggtgcgccgatggtgaggcgttccaggcggccggaggcggcgaccgcggccgcgacccgcagcgcgtcgacccgggtgagcacgtcgcgcgccagcgggagcagggcgcggccggtggtggacaggtcgagccggcggccggtgcggtcgaagagcgccaccccgagggcgcgttccagcagccgcagctgccgggacagggcgggctgggtcaggtgcagccggacggcggcggcgctgaccgtgccggcttcggcggtcgcgacgaagtagcgcagcagccgcagctccacttatgcctccagggcatggtgcacaggcctgacaggacttggacgagcatagtgcgaggtgaacagactgtgccgcgtgagcctcgaacagaagcgccggctggtcaccgcactgcccggcccccggtcccaggaactgatggaacgcaagctggccgcggtcgccggcggtgtcggcaccacgatgccggtgttcgcggcgcgggccggcggcggcatcgtggtcgacgtcgacggcaaccacctgatcgacctcggctccggcatcgcggtcaccaccgtgggcgccggcgcgccgcgggtggtcgccgccgtcaccgagcaggtggcggcgttcacgcacacctgtttcatggttacgccgtacgacggttacgtggccgtcgccgaggccctgaaccgcgtcacccccggtgaccacgagaagcgcagcgtgctgttcaactccggcgcggaagccgtggagaacgccgtgaagatcgcccgggcgcacaccggcagggacgcggtggtcgtcttcgatcacgcataccacggccggacgaacctgaccatggcgatgaccgcgaagagcatgccctacaagcacgggttcgggccgttcgcgcccgaggtgtaccgggcgcccgggtcgtatccgtaccgggacgccggcgtcgacggccgggccgccgcggcgcgggccatcgaccagatcgagaagcagatcggcgcggacaacctggccgcgctggtgatcgagccgatccagggcgagggcgggttcatcgagccggccgccggattcctgccggcgctcgccgcctggtgccgggccaacggcgtggtgttcgtggccgacgaggtgcagaccgggttcgcccgcaccggcgacatgttcgcctgcgaccgcgagggcgtggtacccgacctgatcgtcaccgcgaagggcatcgccggcgggctgccgctgtccgcggtgaccgggcgcgccgagatcatggacgcgccgcacgccggcgggctgggcggcacctacggcggcaacccgatcgcctgcgccgcggccctcgccgcgatcgagaccatcgagcaggacgggctgctcgcccgggcccgcgagatcgagacccgggtgaccgggcggctgcatgacatccgggacaaggacgaccggctcggtgacatccgcggacgcggcgcgatgatcgcggtcgagctggtccgggccgggggccgcgaagccgacccgcggctggcccgggacgtcgcccggtacgcccatcagcgcggcgtgatcgtcctgacctgcggaacgtacggcaatgttctccgattcctgccgccgttgtcgatcaccaatgagctgctcgatgacgcgttcgacgtgctggccgccgcattccaggagattcgatgagcattgtcgtggtggaccccgcctcgttgcgggcggttgccgaggtcccggaccagggcgtcgaggacgcccgggcggcggtcgacgcggcatacgcggcgttccccgcgtgggcgcggaccgccccgcggcaccggtcggagatcctgcgccgggcgtacgagctgatgctgcgcgaccgggagcggctggccgcgctgatcgccgaggagaacggtaagtcactgagcgacgcggccggcgaggtgacgtacgcggcggagttcttccgctggttcgccgaggaggccgtccggcccggcggcgaatacggcgaagccccggccggtggtgcccgcaccctggtcacgcaccggcccgtcggggtcgccgcgctggtcacgccgtggaacttcccggccgcgatgatcacccgcaaggtggggccggcgttggccgccggatgcaccgcggtgatcaagccggccgcggagacgccgctgaccgcgctggccctggccgggctgctcaccgaggcgggcgtgccggacggggtcgtcaccgtggtcaccacctcggacgcgtccggggtggtcggggcgtggctcaacgaccagcgggtccgcaagatcagcttcaccgggtcgaccgccgtcggccgggtgctgctgcggcacgccgccgaccgggtggtcaactcctcgatggagctgggcgggaacgcgccgttcatcgtcaccgaggacgccgacctcgacgcggcggtggccggggcgatgatcgcgaaattccgcaacggcgggcaggcgtgcacggcggcgaaccggttctatgtgcacgcggcggtcgccggtgagttcgtggcccggttcggtgcggccgtcgagaagctcaccgtgggcgcggcggcggacggcgccgacatcgggccgctgatcagcgcgcaggcgctgcggcgggtgacccggacggtggcggccgcggtggagagcggggcgcggatcgcgcaccgggcggcgacaccgtcgctgcccggccacttctatccgccgacgatcctggtcgacgtggcgcccgacgccgagatcctgcacgacgagatcttcgggccggtcgcgccgatcgtcacctggaccgacgaggcacgcatggtggcgcaggtcaacgccgcagagtacggcctcgcggcgtacgtgttctccggcgacctggcccgggccatccggatcggggaatcgatcgaggccggaatggtcggcatcaaccggggcctcgtctccgacccgtcggcgccgttcggcggggtgaagcagagcgggctgggccgggagggcgcccgcgaaggtctgcgggaattccaggagacgcactacctgagcgtcgcctggccggcctgacgcttcccggcggcttgccggcccgggcgccctcgcacctgcccgggccggtcgccgcctgctcggtcagcgcagtccggtcctcccggccgcttccggcaagccggccgctagctagctaggcgaccagcacaccccgcctgccgcgtcccggccgcaccggcagctcggccgtcggggcgaccgcgccccgcagcagggccggcgacggcagtccggcgatctccccgagtacgtgcgcggcctcggcggaagacggccggtcggcgggacgtttcgccaggcatcgggtcaccagccgggcgacgaccggaggcaggccgggcacggccggcagcggtgccgggacggcgtacacgttcgccttgaccatctgggtgaccgtcgacgcctcccacggcatctgtccggcgagggccaggtagagcagcagcccgagcgcgtagacatcggtcgccggacgcaccggcccacccttgacgcgctccggcgccaagtaggccggggtgcccatcagccgcccgtcctgcccgtcgagcgcacccaccgcggccgagataccgaagtcgaccagcttgaccccggccccggtgaccatcacgttcgccggtttcacatcccggtgcacgatgccgtcggcgtgcgcggccgccagcgccgcggccacctgggcgccgatcaggaccgcctgccgccaggtgagccgcccgcgtcggagcatgtcgtccagggactgcccgtcgacgagttccatcacgacgtacggcagccgcccaccggcatcctcgagttcgccgcagtcatggatccccaccacattcacgtgccgcagccgagcggcggcccgagcctcagccgccacctgccgccgcagatcgggatcagcggccaacgccggcgccagcaccttcagcgcgactccccgtccgagcaactcgtcgacggcccgccacaccaccgccgacccaccctgccccagccgtcgctccagccgataccggcccgcgatcagatctccgctctccacggggcattgccgttccccgatggccccgccctaaacccgaccggcccgcgactcgtcggacccgaccggcccatcggcccgtcagcccgtcggggtcaatcctcgacgtgcagcacgatccgcccgtcggccacgcccttgtaccagctcgggtcgctggtcatcacgtcgacgcccaggtccagggcgagcatcgccgccgaagcgcagtcggcccgcccggtcagcgcccgcagcgccaccaacgcatcccagtcctcggcgtcgtcggtgatcagggacgtcgccggatgtgccagcagcagctccaaccgctcccgccccagcaccgccgtgtggtatcccgcctccaccaggcaggacagcggaatgacgaccgcgccatcctcgtcgttcacctcggccagcgtctcaccgaccgccaccgacccgcgcacccacgccgcgatcgccgacgtgtcgagaaccagtttcgcgtcccgcccgccggtcacgccggccgcgaccgcagcccggcgagaaaggccgcccgcccctcgtcgtcccgggcccgctccgctttgcgccgccgctgccgcgcccgagccttgccctcgtcggtaaccgccagccccatccgcgcgtggatgtcctcaacgctcagcttcggcctggtgtcctgttccatctgctcagggtagccgcggccgccctgttgtcctactcccgttcgccccggaatccgctttcgcccaccccaccgcctgcgcatccgctcgggccggccgcatgcgcgacaaaaccgatcgcgaccggaccgggcctgtgtttgggtgacggcatgggccaaccgaccttgcgtaccgaccggctgctgctggtcccactcgccgaccggcatttcgagctggaggtcgggctcgacgccgacgccgaggtgctgcgatacatctgggggcgggcccggacccgggacgaggtggtcacctcgcacgccgaacggatggcgctcgccaccagggtgaacggcctcggccactggatggccttcggcacggacggcggccgccgcggctcgacggcccccgacggcgaggccgacggcgagttcatcggcctgatgatgctcccgccggcgcacggcgacgaccagccggacgatcccacggtcgccgagctgggctatcggctggcccggcggtactggcggctgggattggccagtgaggcctcccgcgccctgctgcggcacgccttcgacacggtgggtcagagccgggtgatcgcccagaccatggcggtcaacaccggatcgcgcggggtgatggagacggtcggcatgcgttacgtccgcaccttccacacctcctgggacgatcccttgccgggcaccgaggccggcgaggtggagtacgagatgacccgggcgatgtgggaatcgcaccgcggcacgctctgagccccgcagccgccactgtctcaccggctcctccctccgctccatcgtgatggccggccaccgcgccggggccgcctcgccggtcactcgacgtccgcgccgccgaagccggggatcgccgcacggcccgccttctggttcgcggtgacataggggcgcaactcggtctcgtaccgctggaaggcggtcgcgtggtcgtcgccggcctcagccaggcagcgggccagcgtggaggcggcgatcaacgcctgggaggtgcccatgccgctggtcggcgcggcgcagtagcccgcgtcgccgagcagcgcgacccggccggtcgaccaggagtcgaggtggacctgggcggtcgaggcgaagtagaagtcgtcggccgcggacatcgcatccagcagccgaggcacctccgcccacggatgggtggcgaacaccccgcgcagggcaccctcatggaccggccgatcgaagcggtcgaactccggattgcccgtcgcgaaggacagactgacccacatccgccccgggtcgatggccgggaacaggtagatcgcgcggcccggcccggcctgcaacaggcctcgacggtcgagctggagatagtcgtcggtgctgaacgccccgccggacatgccgagatgctcgaccgggtcgacgccggggaaggcgaggcggcgcaccgccgatcggagcccgtcggcgccgaagaccaggtcgaagtcgcgcgccggcgccctctcgaaggtcaccgcgacccggtcgtcgtgctgcgtgagggcggtgacggtgtcgtcgaagaggtatgcgacgtcggcgatccggtgcaggatccgggtcagggccaccttgggcacctcgagatcaccgccgaaggcctcggggggcagctcaccgaccggctgcccggtgggatccagcagcgtcgtgccgagcgtcccggtctcgtgggtccggacctcgtcgaggacgccgagctccgccagcacgccgagggcgtcgccgcggaaatccaccgaatagccgctgtctcgcagagccggcgcgcgttcgacgactgtcacctgccagccgtcgcgacggagaaaccaggccagggcgggaccggcgacgctggcgccggagatcagagcgcttctcatgccgacgaccctagcccgctcttatccaagtggtcaatccaattggataagccaggcggataaggaatctggtaggctcggcgcgtgggaaatcgggaggccctcatcgagggcgcgaagcgctgcctgaccgagcgcggctgggctcggacgaccgtgcgcgacatcgcgttcaccgccggcgtcaaccacgccgcgatcggctatcacttcggctcccgcgagtcgctgctggtccacgccctggtggaggccgtcgaggagctgtcggagacggtcgccacccaggctcaggacagctccgcggaggctcgctggcaggcgctgatcgacaccttcggcacccatcgcgcgttgtggatcgcccagctggaggcggcggtgcaggccgagcactcccccgagctgcgggagcggctcgccgccgcgcaacgccagggccgggaggggctcggcggttccgttcccctcgccctgctcagcggtctgatgctgcagtggctggtcgaccccgacgaggcgcccgacggcgcccaggtggtcagcgagctgcgcgctcaggcagccgaggtgtgatccgccatgcccgacgtccgccgcctgattgcgacggccctgcctgactaccgggtcgagtcggtcagcgtgctcggccagggtctggacaacgtggcctatgagatcaacggcgacttgatcgtacgtctcagcaagaccccggacgcttcacgaaccgtccgggaggcccgcctgctcaccgaggtccgccggttcgcgccgctgcccgtccccgagccggtgctcaccctcgccgagcagggctgtctcgcctatcgcaagctgcccggggttcccctgctcgacctgccggcggccgggcagcccgagaggatcatcgccgcgctaagagatttcctggcggccctgcacgccatcgcgccggagcggctggccggcctggcggatgccgacgagcaggcgccgtccgagtggctggaggaggccgccgagacctacgcgttcatctcgcaccggataccggcgtcctaccgtccccgggtcgacgccttcctgtccgccgagccgccgccggccggcgacacgctcgtgttctcgcacaacgacctgggcatcgaacacgtcctgatcgacccggcgacgtcgcaggtcaccggcatcatcgattggagcgacgccgccctggtcgatccggcccacgacccgggccggctctaccgtgacctgggcccggccgcgctgcccgccgatcagtcgccggccgtccatgaccgggcgatcttctacgcccgatgcggcgtgctggaggacttcgcctacggcgtggaaaccggccggacccgatacaccgagaagtccctgaacgcgctggcatggctgttcccaccatagagcgcccccggacgcggtatcggaacgccacaccgccatggactgtcgctgatttgccagttcgtattcgcacggacggcgatagcctcttcacgctcagtggggccagcgcacctcgactcgaagggtgaccatggacgctctagccggccggctcgcggccgaaaccgacatccgtactctgcagatggggcagtactccgggtatctcgacgatccgtcggaacccgcggtcacccggcacgggctgcaacccgacggccgcttccaccccggcgacgtcctggtggacctgcccgccggcgagccgatcggcgacgtcggttatcagaactgtgtcccggcggcgatggccctgctcgcgcaggcctggtacgcggccggcaaggagcagtacaacccgacccttgaggacacgctgcgcatctacgagaaggtctcccccttccggcgtgatccggccggcgcggcggtggcgagcaatgccgcgggcagggcagcgaacgaagcagaccgatcggcgcagcgaccgacccccgcccagccgatctcgaagcaccgggaagcccacaacgacttcggcacgagtctgctcctggcgctgaaggtgtgggtccacaaagaccagccactggccggcctgctcccggaggcccgctcgttcctggagatcgagccccgcaatctggaccagctgcgcgaggcggtgctccggttcggcggcgtcctgctcggcctggcactgcctcagtcgatcaaggatgcgcagggcacgctgcgcgaatcctggtatgtgcccggctacggcccggtctacgacgccactgcgggcagcctgtcgagtcactgcgtggcgatcaccggtttctcgcagcgtgagttcttctgcctcagcgccggtcgggtccggcgactgtcgccggagttcgtgctgacctacgccgacgaggcgtacacggtcaccccgcccgccgcgctggacgccaacccgggcctgcgcgaccggatcagcagggatgtcgacgacatccgcaggagcgaccgtccggccggaatgccggccttcaaccaccgctggcgaggcggcaacatcatgtagggcggggtcatgccgggcgaggccaccggcgggtcacggcggggtcatgccgggcgaggccaccggcgggtcacggcggggtcatgccgggcgaggccaccggcgggtcacggcgggatcatgccccgtgagtcccggcgggtcagcgcgggatcattccgggcggggttccccacgacggatcagggcggcctcccaccggttcgccgccccgagcttcgccaggacgttggacacgtgcacgctcaccgtcttctccgcgatgtccagactccgcgcgatccgcgcattggtgtagcccagcgcgatcaggtccagcacctgcccttcgcggcgggtcaggccccaatcgttcctgggcgccgcttccggcaccggctcggaacggatcaccaccccgctgagcgtcgccagttcggcgagttcacggctgagccgccgggccccgagtccggcggccagccgggcgcccgccgtgatctcccggtgcagggcgctggtcgcccctcggcgcagcaggcaggccgccagtcgcaaccgcgcctgagcttccggatacgggtgtccgagcgcctgccaggtggccgccaccgcggtccacgccgcctcctgcgcttcgccgcgcacccgtaacgcttcggcctgcgccaccgcgtgcagtgcctccgccaccggcagtgcctgcccgccacccgcccgccgcagctcttccagggcctcaccggctcgcccggcgagcatgtccccccaggtcacccaccggtgcaccccgtccggatcggcccgccgcgcctggtccgccgcctcgccggccgcctgcaggccgctgacggcgagccggaggacggggaacgccccttcgccgccgccgagtttggccagcccctcgtcgacggcccgccgggcggcccgccagttcccgtccgcgatctccagggcggccagcgcggcgtacgcatgtccgacgaagtcctgatcggtcttgcccgccgaccggctcatcaccaggtccagaatgtcccgcgcggcccggcgttcgtcacgcgccacgaacacttccgcccgtacatactggatgtacagcggcagatcgtcggccgcttcatcgggcagcacctccccgatgagccgttcgatctcctcccagcgccccaggtcgagcaggatgtcggcggcgttcccgaccagcaccaccccggtcgtcatccgcaacccgaacccggcggccagctcacatccgcgccgggccagcgcgagcccctcctcgagccggttcagcatctgcaggcagtaggtcagattggtgtacgcccgcaggatgttctccttgctgtcggtgctctcggcgagcgcgagtccctcccgcaactgggcgaccccctggtcccgctccccgagcaggaatcgcacggtgccgagcgtgaccagcagataccctcgctcgaccgggtcggctgccacggcgagggctgccgacgcctcatccaaggcctgccggtagtgaccactgagcatcaacacgcgggcgtacgttgcgcccgcgcgcgccttcagtccggcgtccgccagcgacatgcacgtccgggcggaggccaccgcccccggtgtgtcgttggcccgccaccgcaggcgcgcgagatgctcgtacagccgggccagttcctgccggtccccgccggccccgacgacctggatcgcctccccggtcagttgcaccgcccgctgcgggtccccggcgtagtcgagcacttcggccgcctcgtcgagcagccgcggataggtggtctcgcacaactcggccgcttcgggcacccgccgccacaggtcgagcacccgcccgtactgccgccgggcttccgcgtacgcgtgcaccagggccgccgatcgagccgcccgcagcgtccagaacagcgcgtcgtcgtccttgcggccctgaaaccagtggtgggccagttcggcctgcacgatcgcggacgtctccggcccggccgacgcggccagcgcacccgccaccgccaggtgcagaccggcccgctcgccggggagcaggtcctggtagtaggtctccgcagtgagcgaatgacgcaattggtaactttcttcgggcgtacggacaagaacctgccgggccaccgcatcgcgcaacccggaccgcaatgccggaccgggcagcccgctggccgcctccagcaacgccccggagaccggacggccggccgcggccaacaccccgacgatcctctggccctcctcggagagcccttcgacccgcatcatcagcaggtcccgcaggtggtcggggaccggtccgccggggttgcgctgctcggcggcgaggatctcctgggccagaaacgcgttgccgccggaccgctggtacaccttgctgatcaccgcgtccgagatcggcgcggacacgcgcagcagatccgcgagttcactctcgccgaatcgggacatttcccggtacgtcgtcgaccggccccggatcagctcgccgaacacgacccggtggcgcgagtcctcctccagctcatcggtgcggaacgtcccgaccagcaggacggcggcccgccgcaggttgcggctgaggaagagcagcaggtccagcgacgacgtgtccgcccagtgcaggtcttcgagcagcaccaccagtggccgtttcgccgccagccgccccaggaattccaggaacagcgagaacaggtgggcccgggccagttgcccgccctcgcgcgggctgcccgggtcgggcagcgccgggatcagcgcggacagcgccgcctgttccgcgcccggcacctcggcgagcgcctcggcctcgaccgcgcgcatcgccgcgagccacgggctgtagggcagctcgccggcgccgaccgacacgcaggcgccgcgggcgagcagcagctcacgcccggcgcagcgttcctcgaactcctccaacagccgggtcttgccgacaccggcctcgccggcgatcaacacggttcgggggtcgccgcggaccgcgtcgccgagcgctccggccaggtccgccagctcggccgcacgacccacgaagcccttcaagccagccatacattgcagtatttacggacacgacagctccgggaagacgtgcgcgagctgcgcccggctcgacacgccgagtttgcggaacaccttggacaggtgaaattccactgttttcggactcaggaacagccgcgcggcggtctcccgggtggacaccccggtcgcgacgatccgggccacctcgaactcggcgggggtcagcccggccggcacccggctctcatcggtgcctttcagctcccgctcggcccgcgccacccacggcgtcgcgcgcaggtcggcgaaggtgtcccgcgcgatccgcagctggttgcgcgccgcccggcggtccccgtcgcggcgcagccgttccccgtacgacaggtgtacccgcgcgttgtcgaacggcaggtccatcgcccggtgcagcctggtcgcctgcgcgaagcagtcatcagccgaatcccggctggtcaatcccagcacccgccacgcgttcgcggcgatcggcccggccgtcgaccgggtcagcccgtgcaatgtgctcaggtcgtcgcgactcagtgcccgatcccggatcagccggcattccagcaggtccggcaggtgttccgcggccacttcgaccgcctccgccggatcccgcccggcgagcgcgccgagcagggcgagaccggctccgagcggatcccccccactcgccggagccggcccgccccgcagcacggtgatcagcgttcgcgtatgcccggcctgcacggtcgcaccctgatccccggtcagcgcggccagcgtgaccgcccgatccgcctcactctccgccgcgcccaggtcccccgcccgcgccagcgcccagctgcgcagggcaagaacggtcggcaaccggcgaatcgcccccgactgccacattcccgctgcaacccccgcaagcccgcgttccgccgcccggtgccgcccctgcgccatcgccttgcgcgccgcgaccagcgccatgccgaccagcggcgcgggcagcgactccccggtctccgccgcccgccgcagcagctcccccgcccgctgacgctccccggcaagctgcgcgtccgccgccgccagcgtcagcagtcgccgccgccccgaccaggccacctccgcggccagctccagcgccgcagccgccgccgcatgcccgttccccccgcgagccaccgtcgacaggtgctccaaaatctcctcggtcggccgccgcgcgatctccccgaccgattcccgagcctgtccccccgccagaagccgcgcgcttcccccggccgcagccgcccgcgcgacatctcccgccgcgccacccgccaccacttctgttgccgcgcacggaacattcgccacggccccgcgagcaacggtttccgcgagcgggtgcggagcgttcgccttggccgcgtgccgggtggccgtcgcggccggccgttgggcgataacggtcatcgcgcacccccgaacacgctggcgatgacccagcgcgcccaggccatccggcgtaccgcatattccggaatctccccgtagcaggccgccacctcgcccgcgcacccccgtgacccgcggtaacagcggaccatggcgcggacggtggcgtcgacctcgtccctccccggatgcgacccggtcggcagcccactgacgaacagcgcatcggctcgcgccacggtcagcatcgtcgcggacatcttcgctcccctcgccgcttcgcttccggaaacagcctgcgacgcgccgtcgcccaccgattaggtaggtcttcctactcccggtccgcccacctccctaggtcccggccaccacctccctaaaatcgcttattttgtacgtcgaccgcaccgccaccccggggagtcgttccgtgcctgacaccgatgccgatcacgccgagctcaccaccctcgtgcagatcttcttcgacgctttcgtctccggccccgaatcccccgcccgcctcgacacgctgcgcaccgtgcttctccccgaagccgtgatcgcccggaccacgcctgagctggccgtctacaccgtcgactcgttcatcgagccccgtcgcacgctgctgaccagcggccgcctgaccgatttccacgagtggcccgggtccggccacaccgaggtcatcggcgacctggcccagcaccgctgcgcctacgccaagtccggcatcctggacggcaccccgttcaccgccgagggcacgaagaccttccagttcgtccggacacccgccggctggcgcatcctcgccgtcgcctggcaggaccactgaccccgcccggctccaccgatctccctccgtggagggatccggatgaccccgaggagggatcctccggccgcgccgtgccgcgatgctcgatccagcagagatcagccggatccagtagggatcgccgcacagtcgaggagcatcatgcctgcaacgacggcacgaacggcggcactgtccgccatcgccgccaccaccctgtgggtctcccccacagcagcgcaagcccaccctgtactgccgaaacccccagccgtgaccaccgtgtcgacggctgacagcgtgtcgacggcgaacagcatgtcggccgtgatcggcctgggccagatccggctcagcggcccgaacgtcgccggcgaccccgtctggttcggcatcgaagccttcaccgaccggaccggctcagcacacggccggttccggttccggcacgaacgtccggacggaacggttgtcggtgacggctgggccgaggtgacctgcctgcgggtcaccggagacgtcgccctgttgaccgccgtcgtccccgacggcgtaggcgtggtgaagaaccacgcctactacatgaaggtcaccgacggaggctcccagccggaccagctcgccttcgtccaggcccagaacggcacggaacgcccgcccacccgctgtgtcgacttcgacgtcgaacacccgggcctggccgaccgatcccccgtctacaccggcggcttcaccatcctgaccagccgtatcacccccgagggctccgccggcagcacaaccgcccccgcgaacagccgcaccaccagcggcaccggccgcagcgacagcggcggcatcggcagtgtcggggggatccggtgaccatcacttgccatgcggcgccgaagctgaccggtgtgggcgtgtggcggcggtgggccgcgacctggcccgcgtgggccgggtacgcggccgccggctggtcggccgcttacgccacgctcggcctgtattggacgttcggcgggaacggcttcccgttcgccccgatcgacgaagcccacgtgtcgggctccatcctggagggcacacccgtcaccgacggcgcgcccgtcatggccgtgatcggcctgctcggcaccgcggccgcctgggcaatggctcgtggagtcggcatctccggcagagcaacaggccggtccacccctcggccgccgggccgagcccggcccgctgttcgacccttggcgcgtgcgtcgcgtccgagtggacgcgacgtgggagccgggacgggagtcggcacacgggcgctggcgttgatcgccggtggttggatcgtggcggcgggcctgaccctgatcatcccggactacaccatgatcgccctggtggcgttcgcgccgttgctgctggtgttcagcttcaccggggtgccgggcgagcagaacggcatcggcgacattctctactggcatcgcaccaacctgatcatcattttcctcgggggtgtgctgtgggccgcggccaccctggcctaccagcggcgtgcccgcggcgcatgcctgcactgcggccgtcacccggatgccggcggcggccgatcgcgggaggacatgctccgttggggacgtcgcgcggtcgcggtcgccatcacggcaccgctgctgtacgagatcaccagagtcgcctggtatttcggatacccgctcggcatcactcccgacttcctgcggatgatgcaggacacgcccggcatgctcgacgtcggcctgggttgtgccatcgcctcgaccgtcggcggcgtactcacccatggtctggtcagcagttggggcgagacctacccccgctggctctggttcaagaagggcagaccggtcccgccggcgctcgccgtcgtcccggcgtcgatcgtcgcggtctccatcatcccggccggtctgatggtcctctggaccaccgaggtgcgcaccacctgggctctctgggtccccagcatgctctggctggcctggggcgtcggcctgggcgccgccaccatcacctaccacctgcgccggcgcggtgcctgccggcactgcggtcaaggtgacggtcaccccgagccgatcgcaagtccttccgaccggcccgaacccagcccgcactgaccccaccgaacccggcccagcaccgatccagccagcgcccaccgagccaggccctgcacggcacggcgcccaccccgccaggtccggcccggcgctcaccccgccagctccggcccggcgcccaccccgccaggtcctccacggcacggcgcccaccccgccagaacccgcccggcgctcagccggtcagccccggcactgaccacgtgaacagttgcggctggccgagggccgcgaagcacagccctcggccggtgtcatggacccccgtcggtcaagggtgccgacaccggcctcgaccgtggccggcccgccacccgccaccgtcgccagatcacggcggatgagttccagcggatccggcgtgatgcccggcgcgcccgggaggcagatcggggcgtgcgttcgctgtagcggcgtcccgacctcattgggcacctcgcctgaacatcggctcatagccgcgatccgctcgatcgtcacgcgggggttgtgcagaggacttgtccgtctgcggcccgacgggtgccatccactccgctgacgcccgtatctgtctgacctgcgatcctatttgtctttaggggacagttgagccttgttggggcgatctggtgccgcccacagtggtccgcatgttcggtcacaccaagcgggtactgctcccgtccatcgtgctgctgacggcggcctgtgcgagcccccaccccaccctcctcccggcggacgtgcgctcgatggcacagggcgccgacggcgccgccgtcctgcggctggccgaaacgatcctggtcggccggtgcatgcggaatgcgggtttcgaataccccctggatccggccgaggcacggcgagagctggccgccacgccgcccccggcgagcctcgagtcggcctggcaggacgacgacgagaaacgtgcggccgccggtcccaccagcccgcccccggagtcaccgcagccacggaccgacctcgaccgctacgtcgaaggactcgatccgggtcgcgtccaggcgttcaccaccgccctgtacggcgatcagaccacgggcccgtgggtgagggtggagatgcccatcggcaccgtgcggcaaagccgggccggctgccagagcgacgcgcagcgtcggctctacggtgacctcgacgcgtacctccgcggccggatcacccaggacaacctcaacccgatcattcaggcccgggtcaccggcgatgccgcgttcaccgccgccgagggcaggtggcggacctgcatggcgaaagaacattggcccgtcgctgaccaggccgagctcgacacccgcgtggccaaggcgaacgagaacctgccacccgagcagcagaaggagcggtcgcgggacgccgccgtgctctccgcccggtgcaaccggcaaaccggcctgtcggcgaccgcgcggcgccttatccccgtcgccgaacgacgggtcctggccgacctgagccctcagctgaccgatctgtcccgccggcagcaggccgcactgccctacgcgcggcgcctgctcgacggcgaggacgcctgactccccgggaccggcccggggttgcacacccaccaccatgaaggagcaccggcaatgaaacgcaccctagccgtcgcactcaccttcgccggcgccgccgcgaccatcgcggtcgccgcgtcacccgcgcaggccgccccggcccagtgcccgtatcggtcgttctgcgtttacaacaaccagcactacaggaacggcgtctggagcactcccaacaacgacaacgactggtccgacaacctcttcagcaaccggtcggacaacgtggccaaccacgactcgtcctggttcaacaacggctcggcggccagtccgagcttcgtgcgggtgtacgaccggcccggccggaccggcggagtgaccatctgcctggcccacggcaccgggttcgagtccaagcccgcatccgtcagcgaccacggcgaatcgcacgagtgggcgaacggctgctgagcctgcctggacgtgggcggatcggctacggccggtccgctcaccttcatggcccggccggcgtatgttgtcggccatgatcatctgcgagagcggccgctgccgcgctcgccgcggccgagcgtgatctcgaccggtccccaaagagccgttcggtggtgggtcagctcgagcggtcggttctcggcacgatgggatccatcggttgggcggggctgttctctgctccgaaccagtcggccaccttcaccgtgcttccgcaggcgccgcatcccgctcggccgcagaggtatgtgagcccagtggccaagatcgtgtcgcgtgcggcgaccgcggtgtcgtgcatgctcacgactgaagccgctcctcgtcgaagtcgtgcaggtcggtggcgagcaactgctcagcaccgttttccaggagcttggcgcactccgtggagcgcgggagcatcgtggcctcgtagtggcgaagggcctcgtcgaccgtcggcgacgaggccagcgccagggccaactcgctggcgtcgagcatcgccaggttgaccccgacgccgagcggcggcatgacatgggcggcgtcgccgagcagcgtgaccgacgggtgcgggtcccaggtgtgcgggaccgggagggcgaagatcgggcggtcgacgtaaacgccgtcgttctccgtcaccatctgcagcatgcgcggggaccaatcggcgaactcggcaagcagcctggcccggatcccggcggtgtcggcgatggtcagcccggccgcggtgatccagtcgaccggagccttgcgaatgatgtagacgcggatgtggtcaccgctgttgcgttgcgcgaacagggcgcgggtgccgtccgcggcgtgggccccgccctggccgaccagatcggagaggtcggggtgacgctcgctcacgtcgtcgaaccaggcctcgaggaaggtgactccgctgtagtgcggcaccgcgggcgagacgaccgggcgcacccgggagaaggcgccgtcggcgccgatcaccaggtcggtctcggctgtgctgccgtcggcgaaccgcaggacgcggccatcggtcgaggtcagggcgcgaccccactgcaccgtcccgggctccagggagtcgagcagcaggtcacgaagctggccacggtcaatctcgggtttgaccaactcgtcaggcgcgggcaggtggtgctcctggagcgtgccgtcgatgcccagcctgcgcatctcctgcccctcggcgcgggccagccggaagaagtcgtcgagcagcccggccgcacggagcgcgacctgaccgtcgtcggcgtgcaggtcgagggtgccgccctggttgcgggcgtcacgccgctggtcacggtcgtaaacggtcacggcgaggccgtgacgctgcaggatgcgggcacaggtgagcccaccggggccggccccgatcacgctgatccgggcggtggagggtgctggcgaagtcatggtggtgtcctctcggcggcagacggctcgcagggggagccggcgggatgggagcggctcgctggtcggcgagcggccggtgaaccaaggaaagcagacttggtaaaaaagtgcaacaagtcaactttgctttgcactcaacttttgggtacgctgcactcatggatgaacgccccgtcggtcgccgagaacgcaagaaggccgccacccgccaggcgctcgccgacgcggctctccggctgttcctggagcacggctacgaccgggtgagcatcagggacatcgccgaggtggcggacgtttccaccaccactctgttcaagcacttccccgggaaggaggcgctggtcttcgatcaggaggaggatcgggacgcgcaactggtcgccgcgatccgcgaccgcccggacgggcaatcgatccccgacgccctgcgccggcacgtcctcgacacgtatcttccggtggtcgcccacccgctgcgggaggattacacgaggctcgtcgactccactccggccctgcgcgactactcggagcggatgtggacccggcacaccgagacgttggcggccgccatcgccgacgatctcggagtcccgcacgacaacctggaatgcgtgacgctcgcccgcttcgtcctcgacattccgtccctgacccgcggccgtcccgatcaagaggtcgccgtcgagacggtcttcgccatcatcaccgatggctggcacgcccgacggcccggttccgacgcagcgacacccgaccagctcgccgcggaaagctgacgacctgcggcgaggaggcggcgggcggacgccccgaccgtgacagtgagtcgatagcgttccgagagcggacttcgccatcatgggcgagccgggcgaggcgagaacgccccaacttttgagcctcgcccggctcgtgcgcgggctcatcggggaggagcccgcgcacggatagaacgacagcgccgcgctgcaaccgcaagacaaccgcggacgagggcagcgggccggccgagaccacgggcagcgggcagcgggcagcgggcagcgggccaactacgcggaggcggccgcgggcagcgagcagcaggccggccaaagaccatgcgcaccccgcgcgcagccagcccgcgcgcagccgaccctgcggagccgaccctgcgggcagcgggtgggccgaatcccacgcgcgccggccagccgcaagtcgcagaccgcagaccgcaggccgccaaccgcgagccaaccgcgcgaagccgatcaccaggccggcccgcggagatgacccccggacctccgtgcgagttcaccacgatgtggctgaccgcctccccacccccagagtgaccggccaggatgtaggtggccggccgccagctgccggcccggtggtctctgcggccgccgcacggccggatggcgacccgtcgacttcggtgactgcgcggtgagcgaacccggtagcctcatgcgcgccgttcagcggccgatcatgcggcacagaagcgcacgtccgggtgaggaggagcatgatcggctggtcggcggtggtccgccatgcccgtgccgcggccttcctcaccggtctgctggtgctgctgttcagcgtgttcaccagtgtggtgaccgcgcgcgacaagcaggtcgcgacccaggatcacgcgctcgacctgagcctcggtcagcaggtggcggcggtccgcaactacttcgaccaggcgcgggcgatcgccgaggtgttcgccaacaatccggtgttcatcgacttctatcaggcgcccgggaccacccgggagaagatcgccgcgggtggcccgctgatcggtcgggtcaacgacgcgctggcctacctggagcagctgtatccggggcggatccagtcggccagtttcgtcgaccgggacggccggcagatcgcccgggtggccggcggggtgccggtgcgcgccgtcaacctgcgcgacaacgagcagctgcggccgtacttcgcgccgacgctgcagctcgggccggagcgggtgtaccagacggcggcgtaccggtcgctggacaccggcgacatggtgatttccgattcgaccctgctgatggccaacgggttcaccgggatcgtccagttcgaggtgtcgctgtcgagtttccggatgccggacaccagcggcggccgggtcgcctcgatcctcggcgcgagcagcggcgaagtgctgatcgactcccggaccacgggtgtcggcgaccgcacgttcgcgccgatcgcgcgggccggggcgctggccggcatgacgaatctgaacgggctgcgggtcgcctaccagcggatgccggccaccctcaacaacgccaacgactggtacgtggtggtctccgaccaggcgtacggcgccggctggaaccggggtttcccggtccgctcgctggcgctggtgctggccgcgctgctgaccattctgatctccggggtgagctggcgggcccacgcccgctcggtgcgccgggccggcacgcacgacgcgctgaccgggctgccgaaccggaccctgtacaacgagcgcacccaggccgcgctgcgcgggggccggccggccgccgcggtgatcatcaacctgcgcgggttccgggacgtcaacgacgtgctcgggcaccggcacggcgacctgctgctcacccaggtggcgcagcgcctgaccgcggcggtgccggagggcgccacggtggcccggatcggcgccgacgacttcgccgtgctgctgcccggcgccgacgcggcgaccgcgcgggcgaccgcggaggcgctgctcgccgggctgcaccacaccttcgtcatcgacgacttccagctggatgtggaggcgaacgccggggtggccgccgcgcccgagcacggcgtggacgccgagaccctgctgcggcacgccgacgcggccctgcacctggccaaggagcaggtgtcgggggtgcagcagtacgacgcggccaacgacaccggcaccgccagccgtctggaactgctcggcgacctgcgccgggcgatgggcaccgacgatcagctggatctgcactatcagccgaagatcgacctgcggtccggccgggtgaccggcgtggaggcgctgatccgctggcagcatccgaaactgggccggatggcgccggacatgttcatcccgatggccgagtcgaccagcctgatccggccgctgaccgggcatgtgctgtcgatggcggtccggcaggcccggatctgggcggaccggggcaccccgatcccgatcgcggtcaacctgtccacccgctgcctgctcgatccggggttcgcggcgcaggtcttcggtctgctgtaccggaccgggctgccggcgcacctgctcaagctggagatcaccgagagtgccgcgatggccgacccggaccgggcgctggcggtgctgcgggcgctgcacgacggcgggatcagcctgtcggtcgacgacttcggcaccgggcactcgtcgatgacctacctgcagcggctgccggtcgacgagctcaagatcgataagtcgttcgtgcaggcgatggcggacagcccgggcgacgagatgctggtccgcacggcgatcactctcggacacaacctgggactgtcggtggtggccgagggcgtcgaggacgaggcggcggtcgccgcgctgcgcgagctgggctgtgacatcgcgcagggctaccactacgcccgaccgatgcccgccggggacttcgacagatggttcgccgaatactgccagaaagcggccgctccggtcgcctgaggccgcgggacatagacggccgccggtgtttcagggcaggatggggcgaggcccgacgcccaggggaccggcgtccggacgcaaagggcgtgaagacccatgaccctgaccctgctggcatccgacggcggcgtcgtcactctccgcccggcccggcccggcgaccgcaccggcatgctgcgtttccggctggccgccgccgccaccgaccgcatcattctggtggcctgcgccggcccaccaccgcccgacgccgcgaaagaccacgccgcggagaaagacgccgcgaacgaccacgccgcagagaaagacgccgcgaacgaccacgccacagcgaaagacgccgcgaacgaccacgccacacagaaggacgccgccaagaaagcggaacgagcggaaagagccgaacaagccaccgccagaaagggcgcaccacccgtgatcggcgtggcggcctacgcccgcctggacccggccggccgcaccgcggagatcgccgtccacgtcgccccgcaccaccgcggccgcggcatcgccaccctcctggtcgagcagctcaccgcccacgcccggcaggccgggatcaccgaactcatcggccccggccccgatggcggcaccgagctgcgcccgatgctcaccccggcctcggtggtcgtgatcggcgccggcccgcggcacggcggcgccggccacgaaacgctgcgcgccctgcgcgactacggtttcgccggccggttgtacgcggtcaacccggccggccgcccggtctgcggcgtccccgcgtaccgcagcgtctcggatctgcccgagcccgccgacctggcggtggtcgcggtccgcgccgacctggtcccggccgctctcaaggaggccggtcggtgcggggtccgctgcgccgtcgtgctcagcaagggtttcgccagttccggcccggtcagccggcagcgccgcgccgaggtcctgcaggtggcccgggagcagggtgtccggctgctcggcccgagcagcatcggggtgctcaacaccggcccggacgcccggctcaacgcctgtctctccccggagcgcccgccggcgggcggtctggcgctcgccgcccagtccggtccggtcgggatcgcgctgctggccggcgcggcccgcggcggctgcggcgtcgccagtttcgtctcactcggcgagggcctcgacgtgaccgagaacgacctggtcacccactggttcgacgatccggccacccgggcggtggggttgtgcctggagtcggtgcgcgacccggccggcttcgccacgctggtccgggcgctgggccggcgcaagccggtgctggccgtctcacgggccggtgcgctgctggaatcggccggggtcatctgtaccaccgggatcggcgagatgctggacaccgcccggatgctgatcggtcagccggccccggcgggggcgcggatggcgatcgtcggtaacggcggcgggctgaccggtcaggccgcggacctggcggaggcggccggtttcaccctgctgccgctgacctcggcgacccgccggcaggtggcgcgcggccgggacaatccggtggatctgggcatcgacgcgacaccggcgtcgatcgccgcggccgccgagacggtggcgaacagcggcgaggccgacaccctgctgctgatcatcgtgggaacccgggcgaactgtccgatcgccatcatgaccgcgctgggtgaggtggtcgacggccacccggacgtcaccatcgcggcggtcctgaccggcggcaacgacggcatccagaccttcggctcgcgcgccgcgccggtctatccggacgcggcccgcgccgtccgcgccctcgcctacgcccaccgctacgcggtctggcgcaacaccgacacctgaaaccccgattgcggtgtacgtgacctgccacgccgccccgccatggcctaccgtccacgcatggaggtcgacagcgaacgtgacgtggtggccctgatcgagtccgacccggccgccatgcgggttctgcacgccgcggccaccctcgccctgccggactggtggatcggcgccggtttcgtccgcaaccgggtctgggacgcgatcaccggccgcccgccttccccggagcgcgatgtggacctcgcctactacgccccggattccgtggatcctgccgatgacgcccgtgccgaggctcatgccgccgaactcctgcccggcgtgccctgggagatccgcaaccaggcccggatgcatctgcgcaacggcgacgccccgtacacgtcgactctggacgcgatcgcccactgggtcgagacggcgacctgtgccgcggtcaccctccgcgccggcacggtccacctggccgcctgccacggcctcaccgacctgaccaccatggtggtccgccccgcgcccagcttcgacaacgccgcgggccacgccgcggttcgcgcccgcgtcgaggccaaaggctggctccgccgctggcccaccctgcgcctggagctcggacggtaggagagttcagcaccccggaaccgcgacggcggacccgacggcggcgaggtggctgcggatctgctcggccccgggcagccccaggtgggcgcagagggtcagggcgtgccggtagtgccggcgggcccgggcgaggtcgcccaccgcgtggtggacgtggccgaggccggtgtgggcgcgggcctgttggtggccgtcgccgatctcgatcgcgatggtgaccgaggccgtccagcgtcgaccgggaccgatcgcacggtgacggccggtcggcgaggcccctgatccgggtcccgccgccggcctgcccgcgcaaccggccaccagccggcggtcactgccgatcgctgcggctcagcagcgcggtggcgagcagggacaccggacggtccccgtcggtcgagaggtcgcggagcaggtcgtgggcgaggctgccggggagctcggcgagggcctgggtgagccgcagccgggccgccgggccggtgtccggggcggccagctcggcggtcagcgccgcgaggatcggggcggccagcgtcgggtccgcggccagggcgccgaggagttcgcccgcctccacatcgttgggaccgtcgacgaccatggcgatcagggtgggcacggcggccgggacaccgcgtacgcccaatgcccgggcggcctgacgccggacagcggcgtcggtgtcggacagggcctcggtgagcagggcgacggcctcgtcgccgggcagtccggcgaccgcctgcagggctcggcggcgcacatcggcgtcggcggacgccgcaccggcggccagaccggcgatgccgtcggcgccggcccgggcgagggcccagcgcagcgcccccgccacgttcggatcggattcggacagcaccgcgcgggccagcaggtcggccgggaccgcggccggggccagcacggcctgctgacggcgggccgcgtcgggcgagtccagaccgtgcagcaggccgacgatccgggcgacgtccggccagccggccggttcggacacgtcgacggcgtgcagccggtcgaggagttcgcggtcggcggccaggcgctcctcggtccggcggatcaggtcgccgaccagggcggccggggtgaagccgggatcgtcgagggtgcgcccgatctgccgcagcgacaggcccagggtgcgcaggccctcgacgtagaggatccgtcgcaggtcgtccgcagtgtactcacggtagccgccgtgggtccgcccggtcggccggaccagccccagcgtgtcgtagtggcgcagcatccgcgcgctcaccccggtgcggcgggccacgtcaccgatcagcacgacggcgccctcccgagccgggcccggtcaccggtcacctcggccgggaggcatggtgggccagcgcgacgatcctggtcgcctcgtgtacggcgtggtcgaaacccggcttgcgggtcacgcaggagctgctcggtggcgagggcatgcgtacgtacctccggatcgtggttgtccccggccgcccgcaggacgggttcgatcaccgtgccgagcgcgaccagcgaccggctcagactcatccgcacctcccggtcaccgcggccgagctcggcggtcagttcgacggcgagcgccgcccgctcccgttccggcgcgagtgtcgcggccacccgccacgcggcccgcgccacctcgtcgtccacatcgtgcagcagggccggggtgatcgacggccaggcgctccggtcaccgatcttggacagcgtatgcaacgcctgactgcgggcctgcgccacctccgagcccaactccgcgcacagccgcggcacggtgacctcgggcggcagccgggtcagcgcccaggtgagcatgtcccggacgaagaagtcgggttcggccgcgcaccgcgccatcagcatctcgaggtcgtccgggtcagggttcgtcccgatcgccagaacggcctgcaaccgggcggacgcgttggtctcggtcatggataccacctccaccaccgagtcaaagcgttgccatagtgacaaggtcaagcccactcgctacggtctggtggcatgaaacgggctctcgtactcggcggcggcggtgtcaccggcatcgcctggcacctcggactgctctgcggcctgcagcgggccggtctcccgctcggcgacgcggacaccatcatcggcacctcggccggctcggtcgtcggcacgctgctggccgccggcgtcgacctggaggccgcggtcgccgcgcagcaggtggaggcggccgcgccgccgcgctccggcggttccgggcggggcaccagtcagtggctggccgccatgtcggtgctgatcgacccgtcggtgccggcccagcaggcccgcgcccaggtcggcacgatggcctcggccgccgacaccaccgacgagcagacctggctgcgccgcatcggtgacctgctgccgatccgcgactggccgcagggccgtgacctgcgcctggtcgtcgtcgacacggccgacggccgggatgtcgtgctggacgccgccgccggcgcccccctgctgcaggcggtcgccgcgagttgcgcggtgcccggcctgatgccgccggtcaccatcggcgagcaccgcttcatggacggcggggtccgcctcggcgcgggtgccgacctggccgccggcgccgaccggctcatcgtgatcgccccgatggcgatgctgggccgcgagcgcatcgaggcggagatggccgccgccggcgctgccgggtcgctgctgatcgagccggatcaggaggccttggaggccttcggccccaacttcatggacccggcccgccgagcgccgtcggtcgccgccgggctgcggcaggccgaggaattggcggacgccgtacgaggtgtctggcgctgaacgacggagcgagcccgtcgccgcctccgggcggggcgggctcgggctccacactccggagcccgagccgctcacctcagccgagcgcggtcaggaacggcttgtgactgttccggaactcccaggacgagaaccggtcccagttgatcgaccaggtcatcaggccgcggaagtccgggttcaggccactgcgcggcgtgtacccgccacagtcggcgcccttcaccagacaggtcaccgcctgttggatcgcggccggcgcgacatagccgttaccggcgttcgtcgagctgggagcgccgaaaccgatctggtcctcccgcagcgccggaaacaggttcgccgtgttgccggccaccgggaaccccgccatcagcatgtcggtcatcgcgatgtggaagtccgcgccgcccatcgagtgatactggttgtccaggcccatgatcgagccggagttgtagtcctgcacgtgcaggatggtgaggaagtcccgcaccgcgtagatcaccggcagatacgacccggcccgcgggtcctgaccgccccacggccccgacccgtaatactggtatccgagctggacgaagaacgtctccggcgccatcgtcagcacgaacccggccccgtaccgcgccttcaggctcttcagcgcgctgatcaggttgacgatcaccggggtggtcgggttcttgaagtcggtgtccccggtgttcagcgacagcgagtgaccctcgaaatcgatgtccacgccgtccagcccgtaccggtcgatgatcgcgctgaccgagctcacgaacgtgtcccgggccgcggtcgtggtcagctgcacctgcccgttggcaccgccgatcgacagcagcaccttcttgccggccgcccgcttcgccttgatcgccgcgacgaactcggcctcggactccacccccgggcactcgctgaccgggcagaggctgaagcggatgtcgccggaggtgacgctggtcggctcgccgaacgccaggtcgatcacgtcccagtcactcgggacgtcggccatccgcaggtagccggagccgttggcgaaactggtgtgcaggtagccgacgagggcatgcttgggcaggtttccggccgggatgggggtggtcggagacgtgctcgggctgccactggggctcgggctcgtgctgggcgacggcgacttgctggtcacggacggcgatggggacgggttcgtcgtaccgccgcacgcgccgttgttgatccagacatcccactggccgctcttgacgaccgggtcctcaccctgggtccaccacttggcggtgtagttgctgccgcccttggacaccacgttgtccttgacgtaggcgacggacgcgctccagaccggagcacaggccaccgcggcactcgcggtggcggcgacatagacggttgagcacgcagcggccacggccgccgctgccgcgagtatcacggatcgacgcatgctgaattattaggactgttaactgaaaatgtaaagagccttcaccaggcaccgcgtcagcacgaccgaccgtccggaacaccggcaccaccgcctcccccgcggtgccggccggaacctcgggctcaccgggacacgtccggcacaccgaccgcggcgcccggagggccgactggtgatgattcctgaaaccgtcccgagacggacaggacgagtcgcgttgggctcaaccccgggccggagccgcctcgggtgaacccggttcggtccggcgtgccaggttgttgatgagggagcgagctatctcagcgtgcagctcgtttctgctcttctcctcggtaaccgccacaacgagttcgcggacagtggtgatgcggcgatcatcctggctttcctcgcgcagctgaacagcctgggtcgtcatgttcttcctggtcgagttggcctgtgcgaagaacagcgcggaggtgagtgtgacgacagttccggaaagagccgcaacgacagacgcatattgggcgccgtcggtcggcgcccgaaacacggcaagcccgacgccgcaaaagagaaggatcgcgccgatcccggcgaaggacatgctcaggttgaagctgagccgggcctgcaccaaacccaaggtgtagatctcccggagaatggcctcctgtcggcgaagcccctccgcggaccgcgcaagttgctgtgccagcacctcctgggcggggttatacccttcagggtaggtgatatacaggtcactcacattcccagcgatatagacaccgccttgggactcgcccgtgtttacgccccggcgggttgcccgttctgcggagcctacgaagtcggacctgagaatgccgcccaccagaagtagtcccacgctggccaaggccatgggtgtgctgtcaatatgaagagacggaagggcatacgagggcacgagcgcgaagagtaccgcgaatagagcgaagaggactccaagaaggatcaaaacctgcccgagtacgctcttgtcagccagggcatcgctactatcctttatggcgttccttaattctgaagccccctcggtgaaccgatccatccgcccgcttatccaccttcgcacacccatgggtgtcaaagttagcgcccaatagtccgtacggccaagttggacacaggacatcctcgccatgatcaatggcactctcatcggtatgtgaaggcgaagccgggaagacatcttgacgcccataccgaagctttccagcctgttcctgcgcgccgatcgcgatcggttgttccgcctgtaccagggtcgcgtgtctgaacatggccctggtggggcgtcgacccggccgcgacgatgtggagacatcccatggtgttcgggcgtccaggcctttgcggtcgtggttctcggtccggatagggctcgtcctgggtcactacgctgggggcatgacgcgggacggcattcgaggtggtcagcaacgggtcgacgtgttgctcgaccggctgacggacgctgaggagcggctgcatcaactcggggatggtcactgggcgaactggctcgcccgtgatcgggcgcgtgtcgcgcagggcgacgcgtatggcctcgagcacttgaaacaagcgttcggcggcatgggcagcatcaacgacgcctacccgcaggatgacggcgccatcggcgccacattggccgacattcacaggttggcggcccagctactcgccgaccaccaggcagccgacggtccgggcgtgcatcgaagtccgccgcggtaggcgaagggttctctgccgcacccccgggagttccgcgatgatgtcgtgcggacggcccaaggccgcggcccaggcgtgacggcgaggggcgaggccgcggcggggcggattcgcggaaggcgccggggcgcggacacgcggcggggataatcggcggatgaaccccgtgcgcagcgggactccggcggagccggtgcggccggagctggagatggtcaccggcgcggtgtcgcaggacgccgcggaccggctggccgcgctgaccgtgcgcggggcgcggggcgactccgcgatgatccatctgaccgacggccggcacatgcggctgatcggcgggcacgccctgccgcccgggttcgagccgatgcagcaggtgccgatgccgtcgacgctggccgggctggtgatccggaccgggttcccggtggtcatcgaggatgtcgaggccgatgaccgggttccgggtgacgcgccggtgcgggccgtcgggatccgggcgtacgccggtttcccggtccgtgatccgggcggcgtgatcgtcggggtgtgcgcggtgatgtcgttcgaaccgcggcggtgggcgccggaggacctgaccgcggtcgacgacggggcgcaggcgtgcaccgcgttcgtggcggagcagcgggcgcacgaggccgagcaccatcagcggcagtacctggacattctgctggacagcctggacaccggggtggccgcgtgtgacgccgaggggcgcatggtgctggtgaaccggtcgctgcggcaccggctcggggatcggccggtcgacggcagcgccgagcagtggatccggcggctgccggtgaccaccccggacgggcggcccagcgacccggatcaggcgccgctgctgcgcgcgctgcacgggacggacgtgcgcggggtcgagtatctgctgcactccggcgggcagccgcgggtgctgcgggtgaacgcgcacccgatctcggaccgacgggggcggcggctgggcgcggtgaccgtcttccacgacatcaccgaggcgcgccgggccgagcatctgcaggcgatgctgagccgcagcaaggacgagtacctgaacctggtcgggcacgagctgcgcaccccgctgacgctgatcgggtcgtacctcgaattgatgaacgacgccgatccggacgcgcccgccgccgagctgctgccgatggtggccgcggcccggcggggcagtgagcggctgcgccgcctggtcgaggcgctgctcgacctgtccgcgctggacgccgggcgcaacccgctgaatttcgccgacctggacctggtgaccgtggtgagcagcgcggcgtgccagatcgacgaccgggcggcggccaagcacgtctcgctggtccagacgaccccggcccggatgccgttgcacggcgaccagcgccggctgacccagctggtcatggcgctgctggagaacgcggtcacctacaccccggagggcggcacgatcagggtcacggtgagcgggacggacagcaccgcggtcctcgaggtgaccgacagcgggctggggatcccggaacacgagcggccgcgggtcttcgaccggttcttccgcggcgcggtcaccaccgagttggccattccgggtgccgggctgggactggccatcgcgaagctgatcgccgaacgccaccacggcacgatcgccatccacccgaacgaccatcggccgggcaccacggtccgggtcgagctcccccggcccctctagaaggcggtcgggacctggccgtcgatgtggccggcgtcgagcaccttgtcgacgcagtcgatcagctcacgggccaggaacggcttgttcagcaccgcggtggcgcgcacctcgcccgggcccgggtcgccggggaccagcgccccgctgtagaggatgaccggcagcagccgggtgtccgggttgtcccggatccgccggcacagttcgaggccggacagctgcggcatgttgatgtcgctgaccacgatgtcgggccggtcccgctggaccgcctcccaggccgcggcgccgtcggtgacggcggtgacggtgtgcccggcccgccggagcagccgctcggtgacggtgagcaggtcgggctcgtcttccgcgacaacgatgactgccaacgctcaggagccttcccccgtaatgcacatatctggacgattatgtcctacccaccgggaatcgtctcacacctctgacctttcccggccaccatcgggatccgtcgggggcaccggcgccaccaggagcgacgaatgaccgaaaaaatccgattgaccgtacgttcggtcagccgccgttgatcgccgattcctgataggcgggcaacagttcggcccaccgcgcggggccgtcggagcgttccccgccggacaggtgcgcggccagatcctccacgtgcacctggatgccggcgccatacgcggggaggtgctcgatcggcatgccgcgctcctcccacaccagcacggtctgctccccgtccgggatcagcgtcacctcgatgacgtgctcccccacctggtccggctgggtggtgcggagcagcagccgccgcggcggctcgcacgcctcgacgcgcccggtgcccgcccagccgctggcgaagaagtgcgcccggaactcgccgccgagccgcaggtcgccctcgacctcggccatccagcgactcaaccggaccgggtcggtgaccgcctcccacaggtcggcggcgcccgtgttaaaccggtcctcgatccggaccaggccgacgccgtcgacggaccgcaactcgctgatcattggtagctcctccgctcccgtttaccccgggcgatctcggtgtgcagggcatccatccggtgctgccacagcgcgcggtagcgccccagccactcgtccaactcggccagcggctccacccggatgctgtagatccgacgctgcgcctcctgccggacatcgaccaaaccggcctcccgcaggacccgcagatgccgcgacacccccggccgcgcgatcggcagcgccgccgccagctggccgacggtggccgggccgcgggccagggtgtcgagaaccgtccgccggctctcatcggcgagcgcccgcaccaccgcttccatgccgtggaaggtacccagtcggttacgtaaccgtcaagctacatagatgagcggagaccgcgtcgccatcgagtttttccggttcttccgcggttcaggtgggagaaccgacgccggtacgttctacggtcggtgcgtcaaccgaggaggccggcatggtgcgtgaggtcgtcgaggagatcctgcgggtgggacgcgagcacgatgtggacgcgttcgtggcgctgatggcgcccgacggatacatcgagtggccgtatcgtccggacggggtgcctgagcggctcaccggtcgcgacgagatccggtcgcacctccgcgcggccgccgggttcatccgcttcgacgagtaccgggacgtggtgttccacgagaccaccgatccggaggtgatcatcgtggaatatcaggcgttcgggaccgtgctgccgaccggggcgccgttccatcaggtgatcatcgcggtgttccgggtccgcgacggcctggtcgtgtcgtaccgagactatctcaacccgctgccgctgatcgcggcgcgagaggagatcgcccgccggtgagccgcccggccaccgcccacagccgggtgccggcccgtcaccgcgccggccccgcgaccccgagcagccgcgcgccgttgtcgtgcaggacggcccgcaaccagtcatcccccaggcccagtcggtccagaacctcgatctgatgggcgtacgcgtacggaatgttcgggaagtcgctgcccagcacgatccggtcgccgaggtcggccagccgcggcaccaaagccgccgggaacggggcgtagcgggacgtgaactcggtgaacaccatcgtggtgtccaggtggacgttgcggtgggtggccgccagctccaggaacccggcgtactccgggctgccgcagtgcgccaccaccagggtcaggccggggtggcgagcgagcacctcgccgatcgggccggggccggtgaacgcacccggcatcgggccgctgccgcagtggcagacgaccggcgtgccggcctcggcgagcatcccccacaccgggtcgagcagcggatcccgcgggtcgtagccgcccacctgaagatgcgacttgaccacccgggcgccggcgtccaggccggcccggacgtacctctcgacgcccggctcggggaagaaggtcgcggacggcacacagccggggacgccggcggtgaactcccggcaccagtcgttgagccaggcggccatgccgggcttgtgcgggtagaccagcgcggggaaggcgatcaccccgaggccgcgcaggatctccagccgggtgggctcgtcctgccgatagcggatcggccagtccatgccgagggtgggcggcacggcgtcgaagtagtgccagaccttgcgcagcacccgctcgggcatgaagtgcacgtggatgtcggcgaagccgggcagcccgagccgccgcagcaagcccggcagcgcatcgtcggtcagcacccggccagtctgcccgatcagggcccccggtggcgccggacgatgggccaccaggacggtcgggcgtcgaccgccggacgtggcccgccggtcaccatcgcgctcgtgtcgtcccggcaggagagcacagaccggtcaggtgggtcaggaaggcctccaccgcgggtgggcgggtccggccggcgagggtcgcggcgtacacccggcgcaccgactcgtcgtcgggatgaaccgggagcagcgtgatgtcggccgggatggcgcgcgccgccagggacggcaccagggtgacccccaggccggccgcgacgcagcccagtttcgcggtccactcgctgaccgcgacgtcgatccgcggccggaagcccgcggcggcgctgtcgccgagcagggtctgctcgggccgggccgagctcgcgatgaacggctcgtcggccagctcggccagccggacccggcggcggcgggccagccggtgaccgctgggcacggcgatgagcatccgctcgtcgagcaggtggtgcaggtcgaagcgggccgggtcgggtgggccgccgggggcggtgctgaccacggccagatcggcgtcaccggcggcgaggcggtcgagcagggccgggctgagcccctcgaccagggataccgcgaagccgggccgggcggcccggaacgcggcgacggcgcgcgggaccagggcggccagcgcggtggagaaggcgccgacccggagccggccggtggtgagctcgaccgactggcgagccgcgtgcagccggtccagcagcgcctcggcgtgcgggagcagggcgcggccctgctcggtgagggcgacgccgcgcggcagccggtccagcaggcgggcgccgacctcggcttccagggtggcgatctgccgggagaccgcggactgggtgaaccgtagccggcgggcggccgcggtgatcgagccgaggtccgcgacggtccggaacacttcgagcagctgggtctccacggccagccatgctagccgggcatggcagccatgcgagacagtcgctggtggcatggcccggcggggcctagcgtcgcggacatgacagagatcgcggtgctgggcaccggacggatgggtggtgcgatcgcccggcggctgctggccaccgggcatcgggtgacggcgtggaaccggaccggggaccgtgcggcggccacgggggccgccgtggcggacagcccggccgcggcggccgcccgggccgacgtggtgatcacgatgctgaccgacgggccggcggtcgccgaggtcctcacggcggccgcggtgccgccggagacggtggtggtgcagatgtcgacgatcgccccgcgcgagacccgggcgatcgcggccgggatcccgctgttcgtggacgcgccggtggccgggagcgtggacgcggtcgccgccggaacgctgacgatcttcgcggcgggtgcggtcgagcgggccggcggcgtactccagaatctgggtgaggtccggaacgtcggcgaagccggcgccgggtcggcggtgaagctgatgcagaacaccgcgatgctgaccgccctggccgggctgcgggagagcctggcgctggccggcgcgctgggcatcgaccgcgatctcgcggccgggttgctcgccgccgggccgctcgcgacggcgtaccggcgggccgccagcaccacggcggacttcccggtcgcgctcgcggtgaaggacctgcggctcaccggcttcgacgggccggtcgtcagcgcgaccctcgcggcgctcgaagcggtgccggatcagcacgcggacctggccgcgctggtcgggccggtgcgctgatgcgggtcagcctggacagtccgctgcccacaccgttcgccgaccgcttcgccgacgtggcccgcgtcgacctgcccggcggagcactgctgaccctcgccgggcaggtcgcggtcgacgacaccggcacggtgatcgcaccgggcgacgccggcgcgcaggccgtccggatcttcgagatcatcggtggcctgctggccgcccacggcgccggcctcgccgacatcctgcacatccggacgtacctgacggatttccaagatcttccggcgtacgccgtggtccgccgccgcctgttcccgcagaacccgccggccagcacgaccgtgcaggtcagcgccctgttcctggccgaagcccggctggaggtggaggtgaccgccgcgatcgcccggccggcggccggctaaccgcggtcggggacgacggaggtgtcgtcggccggcgggtcggccgggtcgaggcggcgctcggccgcctcctcccgctcctccgccttggcctcaccctcgtcggtggactcggtgccgggcggctcccggtccgcggtcggttcgccgtccgggtggttcgccaggtagcggatcgccgtgttcagcaccgcgagcagcggcaccgcgatcaggccgccgacgattccggcgaccacgacgccggcggcgatcgccaggatcaccgcgagcgggtgcagggccaccgcccggcccatgatcaacggctgcaggacgtggccctccaactgctgcaccgcgatcaccacggcgagcacgctgatcgcggtgaccggcccgttggcgaccagcgcgatcagcaccggcaccgcgccgctgatcgtcgcgccgaccaccgggatgaacgcgccgagaaagaccagtgcggccagcggaatggccagcggcacccgcaacaccaccaggccgatcccgatgcccacggcgtcgacgaaggcgaccagcaccgtggcccgcacgtaggagaccagcgtgtgccacgagtagtgcccggcccgggcggtggggacacgcgcgtcccggggcagcagccggcacaggaacgaccagatctgccccccgtcgcgcaggaagaagaacagggtgaacagcaccaggaagaacccggtgaccacctcaccgaccgtggccgcggtgttcagcgcccccgtcgtgatcgacccctggctgtgcgtgatcgactggcgggccttgtcgatgtagtcactgaactgcgcgtcggtcacgtgcagcgggccgttcgccagccaccgctggatctcgtcgatgcccccgcccacctgtgtcgacaggttgtcgaactgggtgatgaaggtccgcacgatcaacccgagtccgccgaagaccagcagcagtgcggccacctcgaccaggccggcggccagcgagcgtttcatgccgttgcgcaccaggcgggcgcagaccggctggaacagcgcggccagcaggatcgccaccgccaccgggatcagcacgatgtgcagcagcgcgatgatccgcaggaacaggtacgccgcgacgacgaacaggatgaagcgccacgcccacgccccggccgtgcggatgctgctgggcagcacgtcggcactggacggccgcggctccacgacgaccacgtcgggcccggtgaacggcggtggtgcgttacggctctccgcctcggccaatctcgtccgggcacgctcccggaacgtctgcgtccagctggtcatcggctttccccttcggttgtccgcatcgatgcccggtggcgcgctgtttcatgcttgatcagccggtctagggtggcgtttcatgtggcgtgttctgcgatgggtgatggtggcgctgtgggtggtcgcggccggcgcggcctggtgggcggcgccccgcgagtcgaccgccgagcaggcgtccgccgacatcgcggaccaccgggtggtcgcctaccagttcggcagcgggtggcacgacaccgcgccggaccgctggttcagcgttccgtccgtggacgtcaagacctccgacccccaggcgatcttcgcgtggcgcacgccggaccaccgcacccactgggtccgcgacttgcaccccggcctggacccggccggttccggcacgctgatctcgctgagcaccctggtcaacggcatcggcctgctgttcaccgtggtcttcctcggcgtgctgtgggccggcccgcccccgctgaccggcacccggtggtactggtggtggctgttcgccctggtcccgttcgggctgggactgatctggtggaccttccgcgaatacccgtggaaccgcgagccggaactcccggagcggcgccgcaccggcttccgcggcttcggcaccgccttcgtcgtctccctgggggtctcggtggcgctgctcctgctccgccgggtcttcggcgacatcctgttcccggacctgctcaccccgtagtcgtagggaaaggccgtgacccgcgattgccgggtcacggccgttttcgggcgatcaccgctgagccggtatccgaaccgcagctcccatcgaccttgaatcgccgggaccgcgccgatccgaccgtcggcggcggccacgcgctcggggtgctggacgctcagcgcagtccagcgaacagatcgtcctcgggcagcggcgcgccggtggtgtcccggacccggacgaatgtctcgacccccatcaggtcggtgaaacgctccttgcccatgcgcaggaactcgatgttctcgctctggctggcgtgcgccgacagagcgtcgtacttctgggcgccgaacgcccgggtgtccacccacgtgctgatctccgcatccggcaggccgatcgccgggggcggggcgtcctcggtcacctcggcctccgcccagtcgacccccagctcgcgcagcgcctcgccgagcgcggccatccccgagtgcggcgcggtcgtccaatacaccttggccggcacgccggtcagcgcgaccgcggccatggtgacgcggtgcgcctgaatgtggtcgggatgaccgtagaagccgttctcgtcgtaggtgacgacgacgtcaggctgataccgccggatgaggtcggcgagccggtctgccgcctcggcgaccggcacgccccagaacgagccgggcgcgtcgttgctcggccaccccatcatcccggagtcggcgtagccgagcagttcaaggtgcgtcaccttcagcgcggcgcagctcgcctcgagctcctcccgacgcatcgcggccaccgcccctggatcatgccccggcgcgcccggcttgaccccgcccggcccgtccccgcaccgcccgtcggtgcacgtcacgagcactgtcgtgatcccttccgcggcacagcgggcgaggacgccgccggtgctcgaagcttcgtcgtcgggatgggcgtgcaccgccatcagggtcagggatcgatcaaccatgccgacaccctacggcttccggcccggggcccggattcgcccggcgcggggatgcggtgacggtgcgatcggatcgcggcacgagcgaggccgatggtcagacctcaaggaacgcttggtcctgccacacatcctcatacccaggcgccaggatcacgccgaacccgggcggaagcgccaggtatggcagtaactcagggaaacgatccttggcgtgctcgacgtgcacggggctgaagaagtcgtcatcgtcctgcggtatctgcccgccccgccacacgtaccagccgttggactgcccgacgggcggatggcgaatggcgttcaacggctccagctcggcagcgcgccccaggccgacaccgatcatcgttcccggtcgaggtcgaagcggcgtcacgccgaaccgacggcatgtccgacgctgcgccagcaagatccgcacgccggatcctcgcatacccgccacacgcatcaccgatgcgccgggtcgatcgcagccagcacggcccgcggcgatcgaccatgaacacggacgcagtggcacgtgggcgaattccgccggtcatatggccggtgagcgcagcttatgaccgggaccgagccacccttacaaaggaggcgctgctccgtgaaacggctcgaccgtccctggcgcatcgacgactggccggcacagccgagtctcacggtcgacatccggcaggagagtgaattcgcagggcggcggcttatccgaatcgatcggcggatgacgatggcgctgacggttgcgttgccccagaccgtcgtgatgagcgtcattttctggtcgagtgacagcatggtggactcgggaacgaaacgttccgtcgtaaccccggcaaggtggcttcggcgacgtggggcgcgggacccgacgtagcgacgcggggccgttcgagcgcggatcgtggcgggtccaggtaccgaggttgcgttgtagcgcgctcgaagctctagcgtcgtgcccatgaaagcgaacgatcggttacaggaggcgctacgcctggccgtcgacccgcccggcggcgtgtcggtcgaggccttgcaggacctggtccgggaggacctgtccccgcaatgggacatcgcgacgacggccgaccacatcggggtcagcccgcacaccctgcgctactacgagcgagccggcctgatcacggtgccgcgcaacggtgccgggcatcgcgtctacgacgcggcgtgcgtgcggcgcctggtttttctgacccggatgcgcacctcggggatgccgatcagcgacctgcgccactatgtcaccctcgtcgatcgcggcgaggacaccgttccggaccgcctcgacctgctccttgagcaccgcgacacgttgcgggcccagctcacgcagatccagctggccctggcggccaccgaatacaagattgcgacgtacggaggagcaacacagccgtgaacgacccgcagcacgacatcgacagtgtggacaaccgggaacggcgggagcacggcctcgaggttctggcccggatcgacggggccgccggggccgcggtgatcgactcgctggccgacgtgtcaccggctctggcccaccacatcgcggcgttcgccttcggcgacatctacgaccgcccccgcctggacgcgcgatcccggcagctggtcacgatcggtgtgctgaccgccctcgggggatgcgaaccccaactcaaggtgcacgtcggagcgtcactcaacgtcggtctgaccccggacgagatcgtcgaggcgatcctgcacgccgccgtttacgccggcttcccgcgggcgctgaacgccaccttcgccgcgaaggaggtcttcgacagccgtggggtgcagaccactgcctcatgacagcggcctcggcgtgtgccgggagcgcgcggcggagatcggggcggacgcgggctcactgcccgcgttaggctggagagtgggccttacgcatcaggaattcttcgaacggtacatccatgccggtgcgatcagccgggacccggacgcggtcgccgccctgttcacggaggacggtgtggcggaagcgccgctggcgcccgacgaccatccgctccggcggctggtgggccgcgacgccatccgggccggagtcggccgttaccaccggcaactgcgcctgccgggaacgatgaatccgcaacggtcggcctacgtgctgcatgacaccgcagatcccgacgtcttcatcgccgagatcgacgtcgccctcgatcgggccgacgggcggcagaccaccatgtcgttcgtgcagatatttcgtcttcgcggcgggcggatcgccgtgctccgcgactacttcaccgagccgtcacccgtcgccgccgacgtggcggtggcggtggaacctggagaagggtccgcagcacccgcctgatcctcagtgggcgcggcggtgccagaggagggcaccggccaccgccgcgaccacggcggcgatcacgtacggctggtagcggtgcagcgccccgaggatgccggtccagtggtcgccggccacgaagccgaccgtcgaccagacacccacccacagcgccgcgccgatcgcgttgcagaccaggaagcggggccagggcatgccggtggcgccggccaccacgccgttgagctggcgcaaaccctccacgaagcgggcgccggccaccaccttggcaccgtgccgggccatgaacttctcgaaccgggcgaagcgggccggggtcagccggacgaaccgcccgtaccgcagcaccagccgccggccgccgagccgcccgatcaggtagccgacgctgtccccgcagaccgccgcgacgaaggcggtcaccgccaccgcgacgatgttcaggtggccgtgcccggccgccccggaagcggcgatgatcgccgtctcccccggcgccggcaccccgaagccctcgacgaacacggtcaccgcgacaccgagatagccgtacgcggcgagccccgagccgaccatcagcagagccgcgcgcgacggctgtcggatcccaccgacccaccatagaagccgctcgctgagagccgcctgaagcgctggtggccccggaacggctaccgcagcgccggatgcgggtcaccgagcgcggcacgccgccctccggcgaccgtcgtcagcccagaccggcgcgtcggtgatgcaggtggcggcgttcggccggatcgtgggtcagggcgatggcctggtcgtacgcgacggccgccgccgcggtccgccccaggcgccgcagcagctcggcgcgcgccacccgggccggctggaagcggggcgcgtccagcgtgtccaggtgggcgagtccggcggccgggccgtcggcctcggcgatgacgacggcgagcgcgacactgccgccgagcgacggcgccacctcgtcgagggcgcggtgcagggtcagcagcgtcggccagtcggtctgtccgccggcgggacgggcgcagtgcaccgcctggatcgccgcctccagttggaagcggccgaggcggccgcgggcgtgcgcggcccgcagatgccggtgcgcccgggcgatcagccgccggtcccagagcgccgggtcctgctcggtgagcggcacgaacgagccgtccggaccggtgcgggcggccgcccgggccgccgagagctgcaccagggcggccaggccgtgcgcttccgggtcgccgggggccaggcccgccaggacctcggccaggtgcagggcctcggacgggaccgggcggggctccgggccggtggtcgaccagtccagcacgtacaccgcataaaccgcctcgaggacagcggtcatccgccgcggcaggtcgtcgcgggccggcaaccggaacgggatgccggtggttgtgatcttcttcttggcccgtacgaggcgggtggccatcgtggcggccgggaccgagaaggcccggccgatctgcgccgcggtgaagcccagcacggtgttgagcatcagcggggtgtgcaccgtgcggtcgatcgccgggtgggcgcagaccagcatcagctccaggcgccggtcggggatcgcctccacgtcgatgtcgtcgacgtggaccggacccgaccagtccggttcgagagcgacggtgcgccggtgctcggcggacttccagcggtcgcgcagccggttgcgggcgacggtgagcagccaggcgtccgggttggccggggtgccctgctcgggccaggtgcgcacggcccgttcgagggcgtcggccagcgcatcctccgcggcggcgagatcactcgaggccgcggagagaagcgccagcaaccgcccgtagcggtcccggaaggcgaggccggtcagtgcgtccatcgaccgtcgaggaaagcggtggccaccgggcggatctcgatcagccccactgcgcgccggggcacttctccgcccaaccgatcgccgcgtccaggtcctcgacgtcgaccaggaagacgccggccaggacctccctggtctcggcgaagggcccgtcctgcacccgcagttccccgtcgcggcgggtgaccgtggtggtggcgaacgacggctgcagcacgtcggcggagaccagcaccccggcctcgtgcagcgccgcgccgtagacgccgaacagccgccggccctcggccagcatctcctcgccgatctccccgtcggccggctccgggtagtgcatgagcaacgcgtacctcatggtccgctcctttctgtcaccagcatgacgaacgaacggccgcctgatcgtcacccggtttccccgccgagtgtggggtattacgtggcgccatgagggagttggcgtggctggggatcgtccggcacgggcagagtatcgggaacatcgcggccgagcgggccgagcgtggcaacgccgaggtcatcgacctcgccgagcgggacgccgacgtgccgctctcccccaccggcgaacatcaggcgcaggcggtcggcagactgctggccgcgcagccaccggacctggtgatcgcctcaccgtatctgcgcacccggcagaccgccggcatcgcgctgaccggcctggacgtgccgctgctggtcgacgagcggctgcgcgaccgggagctgggcgtgctggacctgctgaccaacgcgggggtgcgggcccggttcccggaggaggagcggcggcgggcccggctgggcaagttctactaccggccgccgggcggggagagctgggccgacgtgctgctgcggctgcggtcggtgctgcgcgagctgcgcgaggaccacgccggcgcccgggtgctgctcgtcgcgcacgaggcgaccgtgtggctggtccggtacctggtcgaggggctggccgagccggaactgatgagcctggcccgcgggcaggcgatcgcgaactgctcgatcagcgcctggcgcgacgggacagccgagcggttcaacgacgtcgggcacctggcggaacacggggcgcccgcgaccgagcaggaggaagtccgtgccgagccggcctgagatcatcaccccgcggctgctgcgcgactggccgctgcccgacccgcaggcgtccgcctcgaagcaggaccgcggcaccgtgctggtggtcggcggggccaagttcacccccggggcggtgctgctcgccggggtggcggcgctgcgggccggcgccgggcggctgcagctggcggtcgccgacgaggcggccatcccgctgagcatcgcggtgcccgaggccaaggtggtggggctgcccgagcaggtggacgaactggccgccgacgccgacgtgatcctgctcgggccggggctcgacgacatcggggagaccgaggcgctgatgcggcgggtgctcggggcggccggcaaggacaccgcggtggtgctcgacgcgtacgccctcggtgcgttgagcagggagccggacctgctgccgcaaccggcggcggtcctcaccccgaacctgaccgaggccgcccacctgctgggccgcgaacccggtgacgacctggtcgcggcgagccgggagctggcccagcggtaccgggcggtggtgtcgctgtacggccacatcgccgacccggccgggaacgtgtggcgggaggagagcggcgacgccggcctgggcacctccggaagcggcgacgtgcgcgccgggatcgtcgccgggctgctcgggcgcggtgcggagccggcgcaggcggcgtgctgggcggcgttcgcgcacgcggtcagcgggcagcggctgtccccccggcacgggcgcaccggattcctggcccgcgagctggtcgatgaggtggccatcacactcgccacggtctgacccacctcaagtcgccgccgcccgggccgattccggtgacaggcggacagtgggtgggaaggcggcacggtggcaggtgtggctctgctcgcggccctggccgaggtgctgctgatcatggtgggcacccacctcggcttcccccacctgctcgtctgggtgccggcggtggccggcccggcgctggcgaccgtcgcgttccaccgcgcctcgcggcgcaccgacggggtgctgcgcgccttctggcggcgggtggcggtggcgatgggcgtggtggcgctcgccggactgagccagacggtcgacatcagcacgatgccgtactccgacctgccgccgatcggcgcccgcacgctgctgctctacctggccggcgcgaccctggcgagcaccgcgctgctgcgcctgcccggcggcggcagctcgtggcggcggctgaccaccgcggtgctggacgtggcggtgctcgcggtcaccggcgggatcgccgtgtcgcagtacctgggctggttcatgaaccgcttcggtgtctccgcggccgcctggtcgctgaacatcgccatgctggccatcgcggtcgccggcgccgtggtggtcatcaagatcatggcggcgcggagcagcccggtcccgcgcgcggcgctgtggtggctggccccgatcggcctggccggcccgctgtccaccgtgacgatggcgctgctcaagccgtggccgcacctcaacggcagcgccgcggtcctgccgttcgtcgggctgtgcggcgtgctcgccgtccgcgcgcggccgcaggccgtgcggctggaccgcccggccgggcccggtcgcgggaccgcgatcccgctggtcgcgaccggtctgaccagcgtcctggtggccaccgtcttcctgcgcaccgggcacctgagcacggtccaggtggccggcaccacgctgctgttgctgctggtcgtggcccggcaggcggccgccctggcggagaacggcgcgttgctgtccacggtccaccaccaggccatgcacgacgagctgaccggcctgcacagccggcgctcgttcaccgcggcggcggccggcgcgcacaccgcggtcctgctcgacctgcgcgagttccgggcgatcaacgacgggctgggcccggccgccggggacgcgctgctgatcgcgtacgcccggcggctgaccgcgctcgccggcccggacgcggtggtggcccggctcggcggcgacgagttcggtctgctgctgcccgggccgacggacatcgtggcccggctgctcgcggccggcgccgaaccgctcgacgcggccggccacgacgtgctggtcgaggtgtcgatcggggtcgccgagggcggcaccgacctgtaccggcaggccgggatcgcactgcgcgaggcggccgccggcgccggcgaccgggtggtccgctacgacgcctcgctcgaacagcgcctcacccgccgcgccaccatcgccgccgacctgcgccgagccctggcggccggcgagttccacctgctctaccagccgatcgtcgaccttccggacggccggctcagcggcgtcgaatcgctggtgcgctggcagcgcgacgggcacacggtgtccccggccgacttcatcccggtcgccgaagacaccgggctgatcgtcgaactcggcgcctggatcatcgacaccgcgatcgcccagaccgcctcctggctgcgcgagcacggcgcggacacgctgcgctcggtcgccgtcaacgtctcggcccgccagctgctcgacccgaacctgcccgaggtggtggcgctcgccctggcccggcacggcgtaccgccgcaccgtctcaccgtcgagatcaccgagaccgcggtcttcgccggcggccgcgcgctggccaccgtcagcgcgctgtccgcgctcggcgtcagcatcgccctcgacgacttcggcaccggccactcgtcgctcggcctgctgcgcacctgtccggtcgacgcgatcaaggtggacaagtcgttcgtcgacggcctcggcggggcaccgcagcaggaggcgatcgcggtcgcgctgcacgccctggccgacacgatggggctgcgcacggtcgccgagggcgtggagacggccgcgcaggcgcggcggctgttcgagctgggctaccgccaggtgcagggcttccacttcgcgaggccgatgccggccgaggagatcacgcgccggctgaccgctgtggctccgaccacgattgccggggtacgggggtagccccgtcccgccgcgccaggccccactccgcccgagcctgcgccagcagtccggccgcgatctcgtcgtccaccccgaggtaacggcgcacccgggcgagcgcctcgaaggccaccgaccgtttcgcccgcccggcatccagcgagccgtcgaacaccgccaccaccgtggccaggaactcgacgtgcgtggtcagcggctcgccgataggtcccagccgagcgtaggtgagcagcgccgtctcggtcatctcggccggtgggttgtccgcccaggcgaacatcgggccgcgggccgcgccgcccgcctgcaggatccgttccaggtgccggctgaccagagcccgcgccacatcggtcaggtgcccgcggtgccgggccatctcccgggccacccggatcagctggcgcggcaggccgccggacaggcagtaggccagcgccacgaacggatcgggcagtccgaccacccgccgaccgagcagttcgacggcccgcacgaaatcgaggtgttccacacggaccatctcgtcgaacgtgctgtcgaagacgtcgcgcagcccgtgcccggccaggtcgaaggcgcgcagcgcgtcctccgacaccgacaccagaaagtagcagcccggcgtgtcgaatacgcctttgatgtcgttgaggaaccgctcggcgccctcccccgagccgatccggtccaattcgtcgatcccgatcacgagcttcggcggtcccggcagtccccgcagtgccgtcaccacctcgtcgagcagctcatgcagggcggcgaccagttccggatacgtgaacggctgcgcctggctgctgctgccgactttgccggtcagctcggcgccccatcgcccgacccgaccggaaagctcccgggagtcggatcgcaggtggcgcagttgggcacgccggcgccgggcggtacgcaggatcgggcctggtccgtgtacggcgaagtagtcgcctaccacgtcgcagatcgacagacagagatgaaggacgaagtcccgaggcgcgtactcgaccggagccgagacgaccacgaccagatcccgggggtcgtcaccatggtgatgacggccgtcgcgcagggcgtgcagcagcatggtcttccctgtcccgcgcggaccggcgagcgcgatgctcgcaccgtcgagctgctccagatgatcgaacagttgctcgacggccggggtgacgatgtggtgttcggtggctctgcggctgcgcagccccggtgcttccccctggatgtcgagggtcagcgaataccgtgcggcgaccgcctcgttgatccggctccgcagaaagggcagcagcgcccgttcccgcaactcgcggcgccagttctggaaagcctgctcggcgtcaccgccgggcccgcggatcggcaggtccagatccgcatcgctcggctggctgacccccacggtcagcatgagaccgagaaggcccacgccgatgctgagcaccaggcagaacaccggcaagcccacgggaccgaatccgaggaacccccacccaccacgggtgtgcgccccgatgaacccggcaccgccgaagaagaccgcgagcatgatcagcatcaaactctggaggctgaccatgggcaggatgtggcctctgccggactctccgtcgtgccgggcggcggccgcgtccgtcagtccgaagaacatgccgaacacggcgcccgtcccgccactgatcaggacgatgaggccgacgacgcgcagtacgtcccgcggatcgtccaggaggaaagcccagatcaccgcgatgatcggcaccccggcccagaccgcggccaacagcccgatcagcgccttgccgatcccgttgatccacctcggaccggtcaactgccgctcggacaccgcggagggaaggcggtggatggtggcctgctcccacgcctgctgttccgcggccacgatcgggaagacatccgtacccgcgcgggcgcacacctcggcacgcagtcgatccgccgggaccctggcatcgagccatccggcgaactccggctcggccagcgcctgatcgaggaggtcggcgagggtccggtcccgtcggcgggcgaaccactcgtcggtgcgcggcgggtggcgcaggaacagcatcggaccaggttcgctcgccgtgcgcccgcagcggaacggcgcgtgcccggtttcacccggaggtggccggtggaccggatcagtcggtggaggccggcgggcggtatccgggccggggcgcgcggggcgggggcggcgggtagtcgcccgggtcctcgtccagcggttcgccgtagatcgacgtctcccgggtcgccggttccggcgccggtgacggggccgccggtgcggcggccgcggccgccggtgcggccgggccggggtcgagggccgcgctcagcgccgctatgacggcgtcgacccgcgggcgcagcatccgccagtcgcgtccggtggccagggccgcgttctccgcgtcgaccgcgttcaccaggtcgcgcagcatgccggcgacctggccggcataggcctggcgttcgccgtccggcacccgttcgagcagcgccgtccagcgggcctccagggcggtcaggtcgtcgcggaccggcggccaggccgacccgcgccgggccgggtcgaggtcggtcagcagttgcggcaggcgcacgcccagcacggcgcgggtctccccggccaggccgcgggcttcggcgtcccaggtggcgacccgccggtcccggttcaccagcagcaggccgaccagcccggtgagcaggccgatcagcagcagccaggcccacggcccgagcccgccgtcgtcctggtcggcgaccggggcgaccgcggccgaggtggacgtcgccgccggggtgggctccttggtggcttcctgggtcgtcggtgccctggtcggctccgccgtcggctccctggtcggctggtcagcggtcggccgggtgcgcgtcggggtcgggtcggtggcctcggtggtcttctcctcggtcggcgtcgaccgggtggtccgctccgccgagaactcgacggtcgggcgggtggacggcaggctctccggcctgttctcgccgccgcacgccgccaggccgcccaggatcaggggcaccagcgcgaacgccgcggccggtcggtgcttcatcttcatgctcctcgatgaggaaagcggaacgtgcgggcgcgtggggacggggcgccggccgcggcaccgatggcgacagcggccggcgccccgcacgccgcgggcgacccccatcggccgcggcgtatcaaggagtgacggtcttcaggccacgatctgcaggtcgtggctggtggtgttgaggcgccgcccgccggtctcggtgaccgtgacgatgtcctcgatccggacgccgaagcggccgggcagatagacgccgggttcgatggagaagcacattcccggcaccagcgtctgctcctccccctccaccaggtagggcggttcgtgcgtggtcagcccgatcccgtggccggtgcggtggatgaaatgctcgccgtagcccgcctcgtcgatcacccgccgggccatccggtcgatctcctggcacggcacgccgggccggaccgcctcgaacgccgtctgctgcgcgagccggaccaggtcgtggacctcgcgttcctcggcggtgggcgggccgacgtggacggtccgggtggtgtccgagccgtactcgtccttgaggccgccgaagtcgaggaccaccatgtcgccgcgccagatgacccggtcgcccatctcgtggtgcgggtcggcaccgttcgggcccgagccgaccacggtgaagtcgacctgcgagtgaccgtgctcccgcagcagccacgccaggtcccggccgacctcgcgttcggtgcgcccctcgaaccggacgccgaggatctcccggtacgcggcgtcggcggccgccgcggccccggccagccggtcgacctcgtcggcgtccttgacggcgcgcagcatcggcagcgccccggtcatcgacacgtacgccgtgccgggcaacgcctgctgcaggccgagcaggtgcagcgcccacgccgagtcggagacggcgtaccggccggccgggtcgagcagccggccggccaccgcgtacgggtcggcgccgtccgcccagtcggtgaccgcgaccggcgccccggcggtgtccggacgttccaggaccggcacgatcaggtgcgggtcgtggtcggcgtccagcaccagcagggtcatccgttcggtgatcgcggtcggccggtatccggtgaagtaggtgaggtccgggccgggcgtgaccagcagcccggtgagtccggcgccggtggcctgcgccaccgcgcgttccatccgctggatgtggtccttgctggtgaacggggtcatcgggcgcctccggcgggtcgggtcgggatggtgtctagctagctagaggtgcacggcggcgaccggtgcggcccggtgccggcgcagcaggagcgccagcgcgacgccggcggccgacatcagggccagcagcagcgcgcccccggcgaggccggcggtcagcgcctcggcgggcggtgcgccggtggcggtgcggccgtcgccgaccccgttggacacggtcgccgcggcggcgacggccagcgacccgccgacgtaccgggccatgttggagatcccggacgcctggccgacctggtcggggctgaccgcgctggtcgacgccgaggacgccgggccgttcgccaggcccaggccggcggcgagcacgatcagcgggacgacgaacgcgccgtacgcccaggacgacctggtgaacaccaggatcccgcagccgatcgcggccagtccgaagccgatcgcgacggcgtaccgcgggccgatccgcaccgccagcggggtgatcaccggcgtgatcgcgatcatcgcggccgccgcgggcagcgtggccagccccgcttgcagggcgctcatcccgaatccgtccgggttctggaaatagagactgagcaggtacatcagcgcgttgatcacgccggccaccagcaggatcgccagggtggcgccgaccagtaccgggttgcgcagcagcgacaggtcgaccagcggcgcggtggcatgccgttcggcgagcacgaagccggcggcaccggccacggccagcagcaggcaggcgatcgtggagaaggagaaccagccccagctaccgccctcgctgagcgccagcaccagcgggaccagggcgaccgcgaccaggaccgtgccgagcaggtcgatctcccggggccggtccgggtcgcgggattcgcggacggtgagccaggtgaccggcacgcagaccgcggcgatcaccgcgtcgatccagaacaggcccggccagccggtcgaaccgaccagcacgccgccgatcagcggcccgatggccgcgccgatcgccgacgcggcgccccaccgggtgatcgcccgcatctgcccggcgcccgccgagtccaccgagagcaggctcatcccgcaggccaggatggtcgagccggccgcaccctggatcatccggccggcgatcaccccggccgccgacgacgacagcgcgatcatcgcgcaggagagcacgaacagcaccaggccgcccaggaagatccgacggcggccgaagacgtcgccgagcgcgccggaggtgacgatcaccgcggcgccgaccagcatgtagccggtgaccgcccactgcagggtggtgaccggggcgccgacgtcctggctgatcgccgggagcaggatcgtcaccgccgacgtgttggcgttcaccaccagggcggacacgcacgccgcgagcaggacgccgagtcccgcggcgcggtcggtgcgcatcggtgaatccgtcgccgccatcggctgctccccactgtcgtgatggggtcagcctcccggcggcggggtgccggagcatcgctcgcgccggatgaatcgccgggccgaccggtccacctaccgtcgcggcatggacgagctcgagctgcggcagttcctgctctacctgggcagcgccctgaccgccgccggggaggcggtcaaccggatcgaggagcacctgctgaccgtcgcggcggcctacggctcgccgcaggcgcgggtcagtgtcctgccgacgtacctggtggtgtcgctggaacccgggcaaccggccacgctggagccgacccgcgcgctgcgcggcgggctgcggctggaccagacagccatggtgtacgacgttctccgcgccgccggtcgcgccgagctgaccccggccgagggcatcgggcaggtgctcgccgcggtccggatgccaccccggttcggcgtggtgacccgcaccgccggacatgcggtgctgatctgcggcatctgcctgatcgtggcgccgacctgggctgacatcctgctggccgcgctcttcgggctggttgtcggcctgatgcggctggccggcgcgcggtgggccagcgctcagatgatcatgccggtggtcgccgcattcaccgtctccgcggtgaccttcgtgctggccgggaccggctgggcggccgccgacctgcgcgccatggtcgccccgctggtgaccttcctgcccggcgcgatgctgaccatgggggtggtggagctgtccgcgtacgagatggtcaccgggtcgagccggctggtcgccggcagcctgcaactgctgctgctcgccttcgggatcatcggcgccgcgcacgtggtcggggtgccggcgccggccgcgcccagcgacgtggtggcgaacacggtcggctggtgggcgccctggctgggcccgctggtcgtgggggtcggcaactatctgctgctggccgggccgcggcggtcgctgggctggctgctgctggtgctctactgcggatggatcagccagtatctgggcaacgtgctgctcggcggctacctgagcggcttcgtcggcgcgctggtgctgaccgtggtcgcgtattcggtcgagcgcctgcccaccggaccgccggcgctggtctccttcctgcccgggttctggctgctggtgcccggggtgctcaccctgatcggggtgaccgagtatctggggcaggacaccgtgcgcggcgcgcaggacctggtcggcgcggccgcctcgatggtggcgatcgcgctcggcgtgctgtgcgggcacccgctgttccgggcggtggcgcgatgaccggcgagggcgagctgaaccaggtcggcggccggccggttcatccgtacgggatgacgatcttgatcttgagggttcgcaccgtggagggatgcagagccgcaatccggtccaaccgctgttgctgatgttcccgctggggctgctcgccgtggcactcatcctggatctggccaccctgctcggcgcgccggccatcatcggcacgctggcctactggaacatcctggccgcgctggtcggcggcgtcttcggggccgcgctcgaccgcccccgggtgctgatcctgctggccgacatgggcgtgctgttcttcttcgcggtgctcgccctgatccgggtgcgctccggagaccgcgcgaccgccccgggcgtgttcctgctggagctgttgggcttcacggccgcgctggccgcgtcctggttcggcgggcggctgggcgccaaccattccgcagggatgagacgagcgacatccaggcctgccgatgattccgcccaacggcatctcgccggtaccagctctcctcgaagggaggcgacgtgagcgctgaggcggacaaccaggcggcagcgccgcccaggtccacacgcgcggtttcctacctctcctgggtcgcgctggccctgatgaccaccagttcggtggcgagcctgcgcccgtcgccgaccatggcggtgtacggcctcgccagcatcttcctctacctcgtgccggccatcgtcttcctgctgccgaccgcgctggtctccgccgagctcgcgtccggctgggagggcggcgtctacaactgggtcagtcagggcctgtccaagccgatgggcttcctcgcggtctggtgccagttcgcgatgaccatcttctactaccccagcctgctcgggttcgtggccagcacgctggcctacgtgatcaatccggagctggccggcagcggcctgtggaccgccatcgtgatcatggtctgttactgggccggcgtctgggtctcctcgcgcggcaccaagggcgtcgccgggctggccagcggcggcctgatcatcggcacgctggtgccgggcgcactgctggtcatcctcggcatcgcgttcctgggccagggcaacgagtcggccgcaccgatgaccgccgatcacctgctgccgacctgggccggcctgtccagcctggtactgatcgtcaacaacttcctgtcgtactccggcatggagatgaacgcggtgcacgtctcctcgctgcgcaagcccggtagggagttcccccgggcgatgttcctggcgatggctctggtgctgctcatcttcatcctgccggcgctggccatcagctggatcgtgccggccgacgagctgtcgctgaccgcgggcgtggtgcaggccttcgacgcggtgttcgccgcgttcgactcgcagtggctcaccccgatcctgggcgtcatgctggtggccgcgtcgctgggcggcatgctcacctggctggccgggccgtcccgcggcctgctgctgatctcccgcaaggagggttacctgccgccgttcctgcagaagctcaacaagcagggcgtgcagcagaacatcctggtcacccagggcctggtcaccacggtgatcgcactggcctacgcgttcatcccggacgtctccagcgtgtactggatcttctcggtgatcaccacgcaggtctacctgatcatgtacctgctgatgttcgtggccgcggtacgcctgcgccgcaaccagccggaccacccgcgcgggtaccgggcgccgatgctcaccgggctgtgcggcgtcggtttcgccgcctcactggccgcgctgctgatcggcttcgtcccgtcgtcgcagttcggcggcggcagtgtcggggtgtacctggccatcgtggccggcggcgcgctcggcctcggcctgctggtgccctacctgttctaccgcttccgcaagccgtcctggaaggaggccaccccgtgagccgctgggtctactacctgatcggtgcgctcctgctgctgctcgccggcttcggcgtcgtcaactaccaagggaagaaggtgaccgaggaggccaccgccaaggcccagcagctgcagaccgagctggccgccgccgggatgcgggtgccggccaccgaccagatcgtccgggtgctcagcaccgacggcggatcgatctgctacgagccgggcgccgccctgcgccgcggcgtcctctacggaatgatcaccaacggcgcggccgggcccggacagcggccggtgatcgtggacagcaggctgctgcagggccagatgaccatcatcaaggtctactgcccggagtacatcgagacgttccagcagatcgtcgacgacttcaccgccgcggaggggtgagccgtggacctgcgagcacacatcaacgagctgatgccccgggcccgggccgacctggccgacctggtcgcgatccggtcggtcgccgacccgcggcagttcccgccggccgaatgcgaacgggccgcggactgggtggcgcgccacttcgcccaggtcggtttcaccgacctgaccctgcaccggaccagcgacggcagcaaggcggtgtacgggcagcgccgcggcaccgagccggacgcgccgaccgtactgctctacgcccactacgacgtgcagccgccgctcgacgagaaggcctggtggaccccgccgttccagctcacgccggtcggcggccgctggtacggccgcggcgccgcggactgcaagggcaacatcgtcatgcacctgaccgcactgcgggccctgggcgacgacgtaccggtcaatctgaagttgatcgtcgaaggatccgaggagcagggcaccggtggcctcgaggatttcgtcgaacggcacccggacctgctgcgcgccgacgccatcctggtctgcgacaccggcaacgcggcggtcggcgtgccggccgccacgatcaccctgcgcggcctggtcaacgtcgtggtcacggtcaccgcgctgggcggcgagctgcactccggaatgttcggcggcgccgcgccggacgcgctcgccgcgctcatccggatgctggccaccctgcgcgacccggccggcaacaccacgatcaccggcctggagaacgagcagacctggctcggcgcgccgtacccggccgcccggttccgcgccgacgccggcctgatcgacgaggcacggctgctcggcgacggatcagtctcggacatgctgtgggcccgcccggccgtcaccgtgctcggcgtcgactgcccgccggtggtcggctcggcggccgccatccagccccgcgcccgggcccggctcaacctgcgggtgccacccggcaccgacccggtcaaggcgcaggacgcgctcatcgcccacctgcatgcggcggcaccgtggggggtccgggtcgaggtcgccaaggaggcactcggccagccgttcgaggcccgcaccggcggcccggcctaccgtgcgctgagtacggcgatgcgcgaggcgtacggccgcgagatgaccactctcggccagggcggctcgatcccgctgtgcaacgtcttcgccggggcgtacccggacgcggagatcatgctgatcggggtggaggaacccctcgcccgcatccacgcaccgaacgagagtgtggcacccggcgagatcggcgacctcgccctcgccgaggcgctcttcctgcagcgctaccgcaagtagcgaaaaccgtgaccgagcgggccgggtctccacccggcccgctatcgtgctgcccgatgccatcgacattcaccttcaccccgacccgcgccgacctgcgctgggtgatcgcccaacggctgcgccccacggtccgcgccctcgccgcgttcggcttcgccgtcggcggcgccggcgtgttcgcgctcgcctcgcacgcggtcctcgccgggctggcgctgctctacttcggcctgctcttcgtggtcaccgccgcccggatggtcagcgcgacactgaaccggatgcccgcgttcaccatgctgccgcagacgtaccggctcgacgacgaggggatcacggtcagttcccgggcatcggtcgtctggtacgcctgggacgccttcgaccgggtggtcaccgccccgggcggctggctgctgttcgccggccggctgaacacggtgacgatcgtccgccggatggtgcccgacgggcaggtcgccgagctggagcgggaactgtcccgggtgggccgcctcccggaggagacgcctgccgccgacgacgcaccggtggcaccggccgccccggcccggcccggcggggtgcgccccgcggtccccgacgaggccggtcccaccggttagccggcccttcccggacggccgcgccgcacccggcccgggccggcaccaccaccgaccggaccacacgcccggacgatcgccgggcggtcgcggcgcgacgagtcgcgcagggccacgaacaaccgacgggtcacctgctcctcccggtgacacgcggtcaagtggtcgatccatcgacgcaggacggcggacaggccgaccgacaacatcatcatcgccgccggccacgggtgaccggccgcgatgctcaggatctccgtcatggtccgctccactcgtccgcgtatcgactgcatcgactctcgaggacgcggcatctttccctctacagtgaggaaactccgggaaactcggaccgatcggagcgggttcatggcgggcggtcggccttcgcagggcaagcagcagcgctacgacgagctcgaagagctggccgcatggtttcggcaggctctcggcgacgcgggcttcggcagcgtgcacgagttcgtcgccaccggaatgttcgagaagaacgcggtgtacggggtcttcaacgccactcgtctgctgaccctggagaacacccagtcgctggcggtcgccctgcgccgcgatgccggcgatgtgcgcgccgtctggctgcgcgccaaggaagctcgcgaccgggagctgctggccgccgagcgcgccgaggagcgacgcctctgttcgtgggcggacctgccactcccgtcgctggcactgcgcaatctgctggagtcgcagagcatgtcggtcgaccgcctgccgtactcgatgctcggcgtgatcgagccgccgctctcgaccgtctatgtccgccagcacatccgttcacaggacaaacgggaccggcagccggcggtcagccgggaggggacgcccgccgaacgctcgccggtgtcgcaggcccagacaaccctgtccgtgctggaggcgatcgagcgacacgaccatctcctggtcaccggtgaggccggtgcgggcaagtcgaccatgacgagttacctggcccggaccctgtcccgggtgtggctgcgggagacgagcgccgcggggctgccgctcggcgagccggtcgtcccgctgcgcatcgcggcccggactctggacgtcgggggctcctggagcgtggtgctcgcccaggcggtcagccggagtctcggacgcagcctcctgcaggatcccgacccggccatcttcacccgacgggctcagggtgcccgctggctgatcctggtggacgggctggacgagattccggacgcccgccagcgccgcgagatcatcacctcgatcgcgcagcacgcccgggccggacgtgactaccggttcgtagtgacgacccggcccctgcccgatgacgacctgtcgccgctgatctcggccgacgtggcccgattcgccatccagccgttcgggcatgcggagctcgaccagttcgcccggcgctggttcggctcccagcggctcgacgatcccgaggaccgtgccgatcgattccttcgggagacctccgacggccggctcaaggagctcgtccgcaatccgctgctggcgaccatcgccggggtcagcgcggtgagagatccggatcgtcccctgccgaccagccggatcagcctctacgaacggttctgcggttacctgctggacgaccacggtgggcgccgggagaccatggcgcagctgcaccggcactatgccaacgatccggatcgactgacgtgtgtcctgtggatccacaagcaccgtaccgcgatcatcggtgccctcgccctcagccgcaccggcgaccagacttccctgtggtcgacggccaaggagtgggttcgccgccatgctccgcacagcgtcaccgaagtggaacagtggaaatcccatctgtgggaggagctgctcgcgaccgggctgctcgtggccaccgacggcgaactcgcgttcctgcaccagtcgttcgccgagtatctgtccgccaagagtcatgcgagcacgctggacgccgacttcgcggccctcgacggatggatccgccgaggcatcggcgaagccgaacgcaccttcgcactcttcgtcttcgggctctgggcggcccgggccgaccatcaggcccaccgcatcgtcgacgtcctgctgtcccgctacgacccgcgacgaacgttgctggccgggcgcatcctggcggagggcgtgcgagtcgacgacccggccgccgagcgcgtggtgacccggttggacgcgctgatccgcaacgagaacgacaccgaccgggcgctggaggcggtgcaggtgctcggcggtcttttcgactatcggtgggtgtcgagcagactggcgggcctcgcctcgctcgactcgttgccggtcaggcgccgggtcgaggcgatcgtcgcactggagcagttggccggcccctcggcgatcaccgaggcgttgaacgacgttctcccatcatgctacgggcgcccgttacgccggatggcgccgatggcggtacgcctgggagcgcccatcgtcgagcagatacgcgagcgggtccagcagatggtcgccgaagcggacgccgacgccgaggaatgggcgaacgcggtggaggttctcaagaagctggggctccaggacgacacggagcggttcgcctgctcggtgttgtccaatccgttcgccaggcaagacgacctcaagaaggccgcagaagcgctgttcgacgcgaaaggcatggcagcgctgccgcaggtcatcgagttcgcgcaaacgcggcccgccgccgactacacgggccgtgcagcgttggccgatctacttcgccgtgagggcgcaagggaggcgtccgcgacgatcgtggagcagatactcgccgacgattccggcacgtcatcgtcaggaatcgctgcggtcaccactgacttgcacctacgggggtctgaagcggttcccgccgtgcttcggcttgaggaacgctggtccagggacggatcttggctggcttccggcgacctgctggaggctgcggcaaaggtagtccccgatgaccgaatcgctggtcgtgcacgtcaacgcgccgtctccggcattcccctcggcgccgacctctacgtcagggcctggctggccgtagaaggaatcgcagccgttcctgagatcatgaaggtgactgatggtggccgccgcttgatttttctcgaccgtgtctgggtcgccaaggcgttgcatgacgtcggcgcgctcccggaggcgtgggaactcgcggagaacgcgttgcggtgcaaggatcgagggcttcgcaccaggtatcgggacgcgggaagcctgctgctgaaggtcgaccacgatcgcggaatcccggctctcatggagatcgttgaaggcgacgccaacaactttccgctgctcggcggactgctggacgcgctgcaggaacacgactcgccaacggccgagcgggcattgcgcgacctggccgacaagctcacccacaacccttatgtgtccagcgtcgagctccgggacgcactgatcaccctggtccgatgcggggagaagccggcagccgtggtcgccgcccaagcggcgatccaccggcagaacctgaccatcgacgatcgcaaggagatcgccgccgcgctggcctcctacgccgagttggagctggcccaggaggtgtggtcacacctcatgcgctggcaggagtacagcctgtcgagcgacgtgaccctggtggacgacatgatcgccgcgggcgcggccgactgggcggcgcaggagctccgggctcagctggacgaccctctgatggcggcgcgccggcgcacgcggcttcggcagatgctggcgcttctgacggccgcggcggacgtgccgggcccggcgcatccggatgatgcgccgggccggtgacgggtcgcaggggtcaggcggagcgggaccgcaggcccgcgatgccgatcaggatgccggcgatgccgacgaagcagagcgtggtcgccccgaagaagacgaacgtggccagccccaggccgggccagaccagcagcgcgaccgcggccagcacgacacacaggccgacggcgatccgggcaccgccgccgcccgagccgaccgaggtgaagatctcggccaggccgtccagcatccagccgagggcgacgatgaccagcagcagcttcagcgagccggccaggtcgcgcaggcagaggatgccgagcaggccgaccaggacgccgaagatgacgccgaggacccggccggcgaccggcgcgtccgggatgaggacgaactgcacgacccggaccacgccgaggatcagcaggttgaggccgaacaggaagccgaccacgtggagggtggccgacggccaggcgaacgcgacgatgcccagcaccagggcgaacaccccggccagcagactgagccagcccgaacgacggaacacctgcgccccctagcggtatcggacctcacggccgtgcgcggccaaggcgtagatcaccagcacgtcggtggcgatcatgatggtgcaccagaccgggtaggcgggcaggaacatcatgttcgcgaacgcgctgagcaccgcgacgatgatgccgatcacccgggcccacatctggcccaggaagatgccgatgccggtgagcaccgcgagcaccccgagcagcaggtgggtccagccccaggcggtgtagtcgaaggtgagcaccagcccggaccgggtggtcaggtagtactggtcgcggaccagggcgacgatcccctcgatcgcctggaatccaccgaggagcatcagcatcaccccggcgaagacgaccgcgccgatccacgcggtgggctcccgggtcgctccgggtggggtgtacggctgctcgtcggcgtacgccgtctcctgctgtgtctcggacatgtcgtttccctccagatcagatctcgcggcgccggaccggcgcccgcggcagatcactgaacgccgccgccaggtacgggccgaccagttcgacgcggtccgcgccggccgcgaccacggcgaacaccgtgccgtcggcggcgaccagccgcaccacgatcgggtcgggcccgcaccgccggcccgtcccggccggcagccggtgcacgcccggcggcagcacccgcaccggcagccgcagcgtccggtcgaacaccggcccacgccggatcagcagcaactccccggcccagcacgcccacatccgccgcgaccagcgccgccggaaccggacccggcaccggaatgccgggccgtcctcggcgaacgcccgccgggtccgccgctcccggcggaccgcggccagcagcacgaggaacaccagcaggaccagcagggtcatgtcaccggacctcccgccctgtcgcgtcatccccgatggatgagccccggctccgggtccggggccgcccgttcatccggccgggccgtcgtccaccggcaggcggcggacctcgatgagccgcagcccgagcccgtgaatccgggagatcaacccgaccaccgcggactggtccgggaggttgccgtgcagcaccgtctccggcggctccacactgaccgtgaggtcgcgcagttcggccagcagctcgtccgggatcaccccggagacccgcacctgataggtcacgtccggcatcgccgtctcctcctagtcggtgccgtgcagcaggccgagccggaacagtcgttcgatccggcgcacggtgtacgggtgtgactgcggcagctgggccagctccacccagaagccgcgcagcgcccgcccctgccgcagcaactgctgcacgtcggtggtgtgttcggtgtgccgcccggaggcgagcagcaccagcccggacgcgccggccgggcacaggtgcgcgccgtgccggtcgcaggagtactcgcgcagccgggacagggtcgggccgagcaccgggatcctctccgaataggcgaccgacagctggtaccagagcgagacgtggtgcagccggatgtggccgagctcgtggccgaggatgaaccgcagtccctcccggttgttctgctgcaggttggcgaacagctcgttggagagcaccacgtagtcgtgcccggtggcctgggccgcgaaggcgttcagcgtcccgttgccgttggccaggtagatcgtcgggcggcggggcagcccgagccggtgcgcgaagtcgtcggcggtcttgtacagctcgccgtactggtgcgggctgagctcgacggcggtgccgcggaccgaggcgcgctgcgtctcccggatgatcaccaacaccggcaccagcaggagcaggccgatgaaggcgctgcgcaccgtggtggcccagccggtcccggccagccggtccggcaggtagggcagggtgaccgcggcctgcacgatcagccagatgatgatcaggttgagcaccaccatgaacacgtagaacggcatctcggccggatgccgcagtggtctaccgcccgatgtcggcacggtccctcctctcgctgcccgcggtcgccggacgggccgcggctcggtgccgactctgtccgcacgccggtggtggcacctcatcccgcgggagtgaggccgccggaccggagcgcccggcaggctggggccgacctaaggaggcctcatggccctgctcgcgttcgtcgcggcggccgccgccgtcgtgctggtgctcgcggtcgccgggatcggcggcagtctcgccctgctgctgaccggcgtggccggcggcgcggtcatgctgctggccgcgtggtggtttctcagccatcgcggcgtggcgcgctgggccgccgggtgcctggcggtgctcgccccggtggtggtcgccgtgctgttcgcccgggcccggctggtcggggtggtggtcgtgttcggcctgctctggtgggccgcgatcgccgccgcccggcgggccctggcggtgcccgtgccggagccggtgaccgagcgcacggcggcgccccgccacccgtacctgatcatgaatccacgctcgggcggcggcaaggtgggccggttccggctcgccgagcgggcccgggcgctcggcgccgaggtgttcctgctggacggttccacggtggacgtggccgaggtggcgcgccgggccgtgcgcgacggcgccgacctgctcggggtggccggtggggacggcacccaggcgctggtcgccggggtggccgccgagcacggcgttccgttcctggtgatctccgcgggcacccgcaaccatttcgccctcgacctcggcctggacctgacggatccggcggccggcctggacgcgctcaccgacggcgaggaggtccgggtggacctggggcgcatcggtgaccggacgttcgtcaacaacgcctcgttcggggcgtacgccacggtggtgcacagtccgcgctaccgcgatgcgaaggtgggcaccgcgctcgacctgctgccggacgcgctgaccggacgctcgcccctgcggctgaccgtggacggcgccaccctggacggtccgcacgccgtgctgatcagcaacaacgcctaccggctggacagtggtcagcgtccccggctggaccgggcggagctgggtgtgctggccgccggccgacggcgggtggtggtccgcaccacgcgggacgcggtcgtcgacgcggatctgccggagattccggtcggggtggacggtgaggcgctgaccttcgcgccgccggtgcgctgtgtgaccgtgccgggcgcgctgcgggtccgggtgccacggcagcgccccggggtgccggttccgcccccgcagctggactggcggcgcctgcgccacctggcgttcggccgggtgacgcaggcgctggacggggccgcggtcagcggcgaaccactcgccgcgtgacgcggcgggcggtgcggcggccggtacggcgggctactcggcgtgatccgaacatggtcgatccccctttcaggctccggcggtctccaggtcgtgcaactccttggcctcctcggcgttgagcaggccgatcccgatcaggtcgaacgggctgatgaacccgtcggcgatccggaagccgccggcccgcgcgatcgcgtcccgcagcggcaccgcccagtggtgctcgatcaggatcagcgcggccgcgctgtcgtccgggatctcggcgagcacgtcccaggcccggccgtcgtcgaagaccgcgacccggccctcggcgtcggccgccgcggcacccagcgcggcaccggcctccatcccggcctcgccctcgatgcccagcccgatcagcgcgccgatcttgctgcccagctcgatcgcctcctcccgggtcaggttgctcaggtgctcgacctccacctcacccccggcgtccttgtagacggcgagcgcgtcgatcacccggacggtgtcgctctgccgcagccgttccagctcggcgatcacctcgccgtggaagtccggatgccggaagcccagcacgatcagctgcacgggtccgatggccatctgtcactccttcgttgtcgcctggttctgaagtccgatcctcgaatcggcggcccggctcgcgcctcatccggcgcgggtgaggaccggcccgggcccgccgcgggacgctgacggccatgaagcgcatcctggtcgtcatcccgctcctggccggcctgaccggctgcgtctcccccgcggaggccgcgaagccgccggtctgcaacagctgggcggcggtgcagcagaccgtcggccacatccgtgaggtgaacgtctcggcgaacgggttgtccgccctgcggccgtacctgatccagttgaaaaccgagctcacccagttcttcgcggacgccaaggcgcagttcggtgcggacggcgaggcgttgaaggcatcggtggagcagctcggggccgatctgcggacggccagggccgatccgacggtggccaacctctccgtggtgcgcacctcggtcagcggcgtgcgtgacgacgcgaaccggctgcacgacaccatgctctcgacctgctgaggggacggccgtcatggaggtcgaacagagccgggcgaccggctgggtggtctgggtgctggtgggcggcgtcctgctggtcatgctgggcaccctgcacctgaccgtcgggctggtcgccctgctgcgcccggaggtcctggccggggagcgcgccgaccagctgctcggcgtgccgctgaccgcgctggccgggatccacctggtgctcggcgggctggccgtccccaccggggtcggcctgatccgcggccggacctgggcccgggtggtcgcggtcgtgctggccaccctggccgcgctggtcaacttcgcgttcgtggcggtccacccggcgtggtcggtgatcgggatcgggctggccgcgctgatcacctgggcggtcgcggcgcacggcggcgagatggccggcgcgtacgggtcgtgatcggccgtctcgacgcatggcagcgcaggcaccgcgtggccgggttcggccacgcggtgctgcgcaagtatctggacgacggcggcccccgggaggccgcgctgatcacctactacgggttcctcagcctgttcccggtgctgctgctcgccgtcgacctgatctcccgggtcctggtgaaccggccggggctgcggagccgcacgatcggggccttcgtgcccgagccgctgcgcgccgacgtcgagcaggcggtggcgcacctgcccacctcggccgtggcgttggtggccggcctgtgcgggctggcctacacggccgccggggtgctgctgtcggtgtatcagacgctcaaccatctggccgccgtgccgtaccgcgagcggtccggcgtgctctcccgctgtctgcgggtgctggccggcctggtggtcctgctgagcgcggtggtggccaccgcgtcgctgccgccggccggcgcgttcgtcgtcgccttcggcgcgctgtggctgatcgcccggctgctgctggaccggccggcgccgctgcgcgcgctgtggccgggcgcgctgatcggcgccgccgcggtgaccctgaccctgcagctgggtgcggcggtgctaccccggctgatccgcggcgccgggccggtctacggcggcttcgccaccgtcgccggcatcttcaccctgttgtacgtggtgagcaacgcgctggtcggcgcggcggaggtggccgcggtccggtgggggcggctgtggccgcgagccatggaccgcggccacccgtcgccggccgacctgcgggcggtcgcgctgctcaagcgggagcaggagcggctgtccgcggaaggaaccaggcggcggccagaccgatgaggccggccaccgcgaccgcgatcatcgcggccgcgtacccggtgcccggccgggagccgagctcggccaccaggatcgtcccggcgaccgcgccgcccagtgccgagcccaggttggacacgctgcgcgacaggccggagatctcgccctgcaggtcctcgccgaagctggactggaccacgttgaccgacggggtgagcatgccgcccagcccgaaaccgatcacgaacaggccgggtacgaacatcgcgaccgacttcgacgcgtacaccagggtgagcagcaggaccacgccggccatggtgatcaggaagccggcgacgatcagcgtgcgctgcgcccgccgcttcgcgaaccgttccgcggccagcgaggacagcagcagcccggccgtggtcgcggtgaacaccaccccggtctcgatcgcgttgtagccgcggaccacctgcaggtacgccgagaccacgaacgaggtccccatcaacatcagccactgggccgactgggtgaccatgccgaggttcgaggtgcggttgcggaacagcgtcatcgacaacagcgccggccgcccggtgcgttccttggcccgcatcgaggcgaagaaccagaggagcacgcccgccccggcgaccagcagggcgatcatcaccgcgacgttgtcgtccgcggccaggatcccggacacgaccaggaccaggccgagcgcggagagcaccgcgccgcccaggtcggtcgggcgcgtcgggtcggccggcagcgggtcgtgcacccagcgacggctgagcaccgcgatcagcagcaccaccgcggtctgaaacaggaacgccacccgccagctgaatgcggtggtgaggaagccgccgatcagcggaccggtcgcggcgccgatcccgcccatggcgctgatcgcgccgaacgccttggcccgcgaggtgacgtcggtgaacagcagggtggtcaggatgtagaccggcgggatcagcatcgccgtgccgacgccctccagcagggagttgccgaggatcagcacgcccaggccgggggccgcggcgctgagcagtgcaccgaccgcgtacaccagcaggccgacggtcaggcagcgtttgcggccgatccggtcggtgagcttgccgccggggatcatcagcgcggccatcaccagcaggaagatggtgatcgccagctgcaccccggcgaccgtggtgccgaggtccgcgctgatgtcgttgatcatcacgttcatgttcgagccggcgaaactgcagatgaactgggccagcgcgaacgggatcaacgcccgtctcagcgctcgcgcggtggtatccaccatgggactgcctctcagtatcggccgctgtcgcggctccacaccgggccgacccggagccagtcccgggtccaggcccgatccctgcgccgatcgaggacgccgcgggcgatccggtggatcccggtcaggccggcggccaggcacagcgtcgtcgcgatgccgaccagcacggcctgaccgaccgggtcccggtcggccggcggcagatgctgcgcgccggtgtcgtcgatccagatcctgatccggtccccggcacgcaacccggagtcgggctgcaccaggccggtgtgcgcggtgccgtccggcgccttccaccgggcgttggcggcggccgccgtggcgctgtccccgccggggctcgggttctcggtcagcaccgcgtccacctgggacaggtgggtccgctcccattccgcggcctgctggacggagcggtagctggccccgccggcccaccgggccagcagcggtgccccgccgaggaacgtgagcaccagcaggaacaccaacaggctctccagccggtccgagatgcggcgcagatcgctgcgcctccgcctgccgatcatggttaggtctgccctcctgccgcagcggaccctcagcatccgatcgcggcggacgggaccgaatcaccccggcagggtgagggccggcggtgccggggtcggcgaggctgcccccatgacgcgcccgcggatccgcctgacccacaagaccgaggaggccaccgccgccggcatctacggcatcatcgtgggcgccgcggtgctggtcaccgcccacggcgtcgccgcctggcgggaggtcctggccgtcctggcgacgctcaccgtgtactgggtcgcggaacgctacgcccggatcgtcgccgaacgcatccacgagggacaccggcccacctggcacgtcgtccgcgagcacctgaccagcggctgggagctggtcaccgcctcgctgctccccctgctggtcctgatcaccatccgcgcctccggcgccgccctgctgaacgccgagatcatctcgctgtcctgcagcacgctgctgctctgcctggccggctggagcatcggttccggcggccgcctcacctacctcgaacggatcgtctccaccatggtcgccggcgccttcggtgtctccatggtggtgctcaaggccctgctgcactgaccggcgcgcccggtccacgccggcacggagtcgccaccgcgcgcaccaccgtccgcagccggacaccgcgaccggcgcggccacggcggtgcggccagtgtgaccgcgaacgttcaccgcgttatgaacgccgggcgcctgtgtagatttcgtagcgggtcggtcggcggtctggttcgtgtacgcggggcttggcagcctgttgtcatgatcatgattcgtagtgcgcctcggccacggcggcacggtcgactgctctccgccgttgcggtgggatggttggtggtggcgagcacctattacctggcgatgccgctgttcggtgtgttgtcgctgttcggctggctggtcatcggcggatgctgggtcggggtggttgcgacctctgccctggcgatgctggcctcgtgtcgggacagggcgtatggctgggcggtggcgtgtctggtggtcgcggttctctccggggtcggggtggtcagcacggattggcggccggtctacaccgacagccagttccggttgcaccgtggggagctgggtgagttggccgccgaatatcaggccggccggttggtgtcggacagcgaattgccatggcggctgcggtacctgtccatcgatgggcaggcacatgttcgtgatggggctctctaccttccggtctgggcagactggagagccgagagcggcggaggtttcgcctacttcccgtcatcgcccgggccggacaccatggtcggcaccgctgccggggataccggccggccggtgcgggcgctcggtgacggctggtggtgggtggactagaccgagtctccatgaacgagtcctggtggacatcgtgggcgtgggtccagtggtatcggaagatcagcatcgaccagctcaaggggttccctgcctcctgtggtcacggcgtgaacggtgcccggcagcgatcgtggccaggccggcggagcggggtcgcctggatttcgggtcctacgatgtgccgcatgcagcagagccgacacgacctcgaacggcaggccaacgacctggccgggatggcggcccgagcgcacgccgccggccggccggatgaggcgttggctcatgccggccgggccgtcgcggtcgtggaagcgatcgtcgcggcacaccccgccgatgcccaggcgcactgggtgttggccggtcagctctacaaccgcgccggcatccacgagtcgctcggcgacttcgcggcggccgccgtcgacgccgcccggtccttcgagatctaccagcgcctggccgcggtggcgccgctgtgcctgccgcagcgcgccgacgccgaggcgaggctggcgcggacgtcggccttcgccggcgcgcagcagggggtcgatgccggacccacccgcgaacacgccgcggccgccggtgaccgggaactacgtgcgggccctgttcgtgctgggcgttctgcagcaggagctcggtgaccccggggcagagcagtccctggtcgatgcgcgatacctgatcaccctgctgaacgagccgttgcccgccgacatcgccgagatgcgcgatcagctcgaccacggcggcgaaccgggttcacccgccggaggcgaccggtgaacccgggacggtggtcaggcggccggtgtgccagccggcgccggacgggtagcgttcgaccaccgtgaccgtgccgccggcgacggtgatccggctccaggagcgcggtgtcccccgcgtccgccggctggtcgaggtgcccgcggtgatcagcaccggcccgccggccagccggcgcacctccgggatgtgggtgtgcccggccaggacgaggtgcacgccggcctcccgcgccgcggtcagcagccgggaccggccgaccagtctccggccggtcggcgggtggtgcagggcgatcagccgcagcccgtccggtggcgcggcggcgaaggccgccgtcagcgacgtggtctgctgccgggtgacccggccgtccttccaccgccaccgcggcatcgaggcgaccccggcggcggtcaggccggccaggtggatgaccgggtccaggtcgtcgcagatccaggttcgatagcggtcgtacgggcgcagcagccgctgcgggccggccagcggcaggtcatggttgccgagcacgctgagcaccggttccggcagccgtttcagcagctccttggccaggtcgaactccaccggccgggctcgcatggtccagtcgccggtcaccaccgtgaggtccggccggaccgcggcgacgtccgcgatcaggctctgcaccgccgcgtcgtggtgcgccccgaggtgcaggtcggacacgtgtgcgatggtcagcacgacgcgaagcgggacggcggtgcggaccagaccacgggacggggcgccggcccggccggaggaggtccgagccgggccggcggggtgagcgcggcgacagcgctcaccgggagggcaggcccggacgccggggtgggcgcaggtcgtgcgggccgccgtagtctccggccggggtgacgacggtgccggccttgccggccaggatcgccgccgcgtcgtcgagggcgccgatcgcggccaggtcgccggtcagttcgacgaaccggcacaccgcctccaccttgggtcccatcgacccggccgggaagtcctcccggcgcaggtcgcccggggtggcccggccgatcggttcgggtgccgggccgccgaatccgcgctgcaccgccggcacgtcggtgagcagcagcagcgcgtccgcgtcgagggactcggcgagcaccgaggtggccaggtccttgtcgacgacggcttcgacgccgcgcagccggccgtcgtcgtcccggatcaccgggatgccgccgcctccggcgcagaccacgacggtcccgtcgaacagcagctgccggatgatccgggtctcgacgatccgctgcggttggggcgacgggaccacccgccgccacttcgggccgtcggcggcgaccgtccagccgcgttcggcggccaggcggtgggcggtgtcctcgtcgtacaccggtccgacgaatttggtcggtgcggcgaaggccgggtcggcagccgagaccagggtctggtcgaggatcgcggcgacctgccggccgggcagcgcgttctgcagcgcctgcagcagccagtagccgatcatgccctgggtctgggcgccgagcacgtcgaacgggtacggcgcgcgcaggccggggtccgccgcggattgcagggcgagcatgccgacctgcggcccgttgccgtgggtgatcacgatctcgtgctcggcggccagtggcgccagcgcctcgaccgcccggaccgcgttggcccgctggaccccggcgtccggccggtccccgcggtgcagcagcgcgttgccgccgatcgcgatgacgatccgcatcgcgatcaggctcccagcgtggcgaccatgatcgccttgatcgtgtgcatccggttctcggcctggtcgaagacgatggaggcgggcgattcgaacacctcgtcggtgatctccagcgcttccagtccggtgtgctcgaagatctcctcgccgaccctggtccgccggtcgtggaaggcgggcaggcagtgcatcaccttgacggccgggttccgggcggcccgcagcagttcgctgttcacctggtacggccgcagcaggcggatccgctcgtcccaggcgtccttcggttcgcccatcgacagccacacgtcggtgtagaggaagtcggcgccgtgcacgccttcggcggcgtccgcggtgtgcgtgatccgggcgccggtggtctcggcgatcgcccgggccgccttgatcacctcctccgggttccaccgggactcgggggcgaccatgcgcacgtccatgcccatcatggcgccggcgatcagcagcgagttgcccatgttgttgtgcgcgtcgccgaggaacgcgaacgccacctcgttgtcgtgcttgaccgtgtgctcgcgcatggtgagcaggtcgcacagcgtctgggtggggtgccactcgtcggtcaggccgttccacaccggcacgccggcgtgccgggccagggtctccacgctgtcctggccgaacccgcggtactccagggcgtcgtagaaacggccgagcacccgggccgtgtccttgaccgactccttgtggccgagctgggtgctgaccgggtccaggaaggtgacgtgcgcgccctggtcgtgggccgccacctcgaaggcgcagcgggtccgggtggaggtcttctcgaagatcaccgcgatgttcctcccggtcagccggggcacctcggtgccgctgtacttggcggccttgagctgggcggcgagccgcagcaggaagcgccattcgtccggggtgaagtcgagttccttgaggaagctgcggttgcgaaggttcacggacatgatcggtatccccctgagggctagacggcgtcgcgttcgatcgggcaggtcatgcagcggggcccgccgcggccccggccgagctccccgccggcgatggtgatcacctcgacgccgtgccggcgcaggaaggtgttggtggtgacgttgcgctcgtaaccgacgatcaccccgggctcgacggccaggaagttgttcccgtcgtcccactgctcgcgctgggcggcccggatgtcctcggtggtctccagcacctggatcttgtcgatgcccagggtctcggcgatggtggcgaacaggtcgtcgttgcgggtgacgtcgaggccgtcctcgtcgtcgccgggccgcacggtccaggaccgcagcgcctcctgcaggtacgggtacatcacgaaggtgtcccggtcgatcatggtcatcaccgtgtcgaggtgcatcatggcgtgcgagtgcggcagttcgatggcgatcaccctggtcgcggcgccggccgtgaacagcgcatgggccaggttctccacgcccatcgcggtggaccgctcgcccaggccgatcatgacggcgccgttgccgagcacgtggatgtcgccgccctccagggtggccggctggtgcacccgatcgtcaccgccgtaccagaaatcgaagtcggcgagggtgaacatcgggtggaaacggtagatggccgagctgtgcaccgattcgcggtgccgggccgccatcgccatcgggttgacgctgaccccgccgtagatccaggccgagttgtcccgctggaacaggtggttgggcagcggggtgagcacgaagtcgtcggcgctcatcagttcccagcgcagactgttcacggtgaagccggcgagttcctgtttgagcaccccgccgatcaggtagtcggcgagccgaccgctctcggcctggtcggcgagccggcgcagcggcccggtcagggtcggcccgacggtgttctcggtgatgatccggtccaggatccaggagcgggcgtgcgggatgtccagcacgtcggcgagcaactcggcgaagtagtgcaccttgatcccgcgctcgcgcagcacctcggcgaacgcgtcgtgctcctcgcgggcccggcgcgcccacaggatgtcgtcgaagagcaggtccttgacgttgtccggggtgagccggctgagttcgacgccggggcggtgcaggatcacctgccgcagccggccggtctcggagtcgacgtggaatggcatggggtctcccgggtcactcgtgggcggggacgggcggtggcgcggtcatgtgtcggcggacggcgagatagaccggcacgccgagcaggaacgcggcgccggccatcaggaacgggccccagaccacgtaccagtggtcctggccggtgttgcgggaataccagacgaacaggatggcgaagatcagggccagtacggcgatcaccgcgtcccgggtgagccggcccctgacccgccatctgagctgggcgagtgcggagaacgcgtacgggatggcggcggtgatgccggtcatcaggaccagggtgttgaagacggtcgccccgctcgcccccatgtagctgaccgtcatggccagactgcccaggatcgtcgaggacaggatcccggcggccggcacgccgcgtttcgacagccggccgaacagtgccgggaagacgccgtcccgggccgcggcgagcggcatctcggcgcagatcatggtccagccgttgagcgccccgaacccggagacgatcacggcgagcgcggtcaggtcgccggcccaggtgccgccgccggccatcaggttcgcggccgccgagtaggacgccttgtcgtcggcgagcgtgccggccggcacgatcccgaacaccgcgatcatcgacagcaggtagacgacggcggcgccgagcgtgccgagcacggtggccttgggcacgttcttcgcggggtcgcgcaccttggcggcggccaccgcggcgcactccacgccgaggtagctgaacaggcagatggccatggcgctgccgatcgccttcccgtcgccgccgccggtgaggttggccgggtggtagttggcggtgctgatgaagaacagccccgcggtcgacatgttcaccagcgggatgaacttgatgaccgtggtccacagctggaccgcgcccatgttcttcacgccggtgaggttgatcagtgccgggatccagaggccgaccagggcgatcacgatcgaccagagggtcttgccgtccttgttgacgaaatgctcgacgtagaagacccagccggtgacgatggccgcgttcccggcccaggcggtgatccagtacgaccaggcgttgacgaagccgacggtgttgccgaacgccgcgcgggcgtacgcgtacggtcccccgtcggccggcagccgccgggacagcgccgcgaacatcaccgcgagcgccagcgccccgaccgtggtcagcaccatcgccaggatgctgatcgggccgatcccggccagcgagtacggcaggttgaagatgccgaccccgatgatggtgccgaggatcagcgcggtcgcctggggcagcccgagggtccggttcacggcgcggccggttcgaagcggcccagttcgtcggcgcccttctggatcacgccgtacgacgcctcgggcacctcctgccacgccccggtcagctcgccgagcggctcggagaccaccagccgggtctccccggaaagcccgcgcagcgccttcacctcgggatgcagctgttgcagcgcggtcatcgcggtgctgtagaacagcgaccggctgtgcccctcgctggagtagcggaagcaccagaaccggtcaccgtcggtggtggccacggtcatctgcagcgggtcgtccaccccgtgcgcccgcccgaccgcctcgaccagcccggccatccgttccaccgcggcgaccggccggtcccgcaacccgaaggtgagcgccaggtggaacatcacctcggagtcggtggatccggccagcgccgggtacaaccgcgggtcgacggcgagcaccagatcccgcttgagccggccgaactcgcggatcgacccgttgtgcgcccagagccagttctcgtgccggaacgggtggcagttggtctgctgcacggcggtgccggtgctggcccggatgtgcgccaggaacagcggcgaggtcgtcgacccggccacctcgcgcaggttggcgtcgctccacgccgggcccacgccgcgcagcagggccggctcggccggcccgtccaccggataccagccgaccccgaagccgtcgccgttggtggtctccaccccgaggcgggcgtgccggctctggtcgatcagggagaaccgtggtttgtagagcagctcttccaggcggatcggcgtgcccgagtacgcaagccatcggcacatcgcggctccttcatccagtcgatgccggtcatcgtcatcgcgcgccgtccctgacgggctcaccccggcgggatgagcttgcgatccggccggggtgaggcgcggtgcgagcgcgacgacgcgtacgcggcaatcggtttcacccgccgcgagtggcgcgcgcggtgaccggggagcggaccgtgagcggcggaggtgagcgggatgccggagttcagcggtctgccggagcgcctgccgcgccggtggcgggcgcgggccgcgctgatcctgggcagccgggtcggcacggtggcgatgcgcgggttcgccgagttgatccgggtgcagatcttcgatcgggcgatgaccctggccgcgcagtcgttcacctcgatcttcccgttactgatcatgctgctggcgctgctcgggccggcctaccgggcccggctgaccgatctgctgcacctgccgtcgggcagtgagcggctggtgcagcaggcgctcagcggcagccgcagcaacgcgttcggcgtggtcggctgcctgatcgtgatcctgtcggcgaccgggctgagccgggccctggtccgcagttaccgggcggtgtggcaggtggcccagaccccggccgggccggccgcgaccgggcggcaggtcgggacggtgctggcgctggtcgccgtcctgctggtcgcccggctcctcggtcgggtcgccgcgcggctgcccgcgccgcacgtgtccggggtgctgttcaccctggtcaccgacatcgggctggccgtactgctgccctggttgctgctgggcgccgcggccccgcgccggccgctgctggccggcgcggtcgtgttcggactgctgatgatcgtggtgcgcgccgccggggtggtgtatctgccgcgggcgttgcagtccagcaccgaccgctacggcacgatcgggctggcgttcacctacctcggctggttgtacgtgctcgcgttctgtctgctgctggccgcggtggccggcgggatggtcagagcagccccagttgacgggcgatgaccacggcctcgcggcggcgaccggcacccagcttgcggtagatcgagcgcatgtgcgccttgaccgtgttcaccgagatgccgaggttctcggcgatctccccggcggtcagcacggtcggcaggtactgcagcacgtcgatctcgcgttcgctgagcgggccggccgtcggcggcgtaccgatcgggatctccccggtgatctcggcgagcaccccctcgccgacgcggccgcgcggctcggtcagccactgctgccgttcggcgagggcgagcacccgggcgttgtcgaagcggcggaacgggcggcggatgccgatcggttcggccgcggccagcgcctggccgagcgcctcgccggcccgctggccgcggccctgcgcgtcggcggccagcgcggtgagcagccacgcggagaccgcggcgacccggtccggcccgtcgcgcagcagggccagcagttcctcggcctcggcggtccgcccggtcagctgacgggcgtgcgcgagcagcagctgctccggcgggtagaggccgtcccggtgggcatagcgggtgagcaccgggcgtggatcgccgagtgccaggtcgacctcgctgtgggccagctcgacgatccggtcgagcatcggggcccgcagggccgggccggcctccgcggccagggtcgccagcacggtgcgggcggtccgcggctcaccccggtcgatcagcaggtaggcccggaacaccgccatcagcacggtcatcgccgtctccggctgctccccggaggagtgcagggcccggcgcagcgcctcctcggcttccggttcggcaccctgccacaggtcgagggaggcccgcaccacgtacgccggggtgaccgagaaccggtcctccgcgtcgatccggcgggccaccccgagcgcggcgtcggcatgctcgccggcctcccgcagcgagccctggatcagggcgagcagggccagatgtcccagggcgttgacctcgaccagcgggatgccggccgcgcgggccccggtcgcggcggcccacagatagcggtccgcgtggtccagccggttcgtccagagcaggccgatgcccttgttgagcagggccatcgcccggtaccgcaggactgccggggcctcgtcgcggtgcagccgggccagatcggtgagcaccccggtggtcgtggtgaccagccgcggcatgtcgccgcgccagcggatcaccagggccgcctcgaacaggtcgagcaccgtcgcgatcagctcgcggccgccgtggccgcgctcgcgcagcagttcccggacccggtcgatcccgcgcgcaaggccactgaggtcgcccaggccgtaccgcagcatgaccaggcacagggtggattcggcggtctccgggagccgggccagcgggatgcgccgcatcaggtcgatcagctccacccggtccggcgagacgaacagcgccagcccgtggtcgacgagcagccgggtgaccagttgccagtccccggcggccgccgcgtggtgcagcgcggcgagcgggttgtcccgcccggcgtgccactgggcggccagcaggtgcacccgggccgccacgtcctcgcactcgcgggcgagctgcccgcgcagcgcggcccggaactgccggtggtagcggtaccagccgtggccgccgacccgctcgatgaacaggttggcccgttccagccgggccagcaactgctcaccggggcgcccggtgaccgcctcggcgaggctgccgttgatccggtcgggcacgctggtgcccagcaggaagtcccggaccggcgtcggctgcgccgccagcacctcgcggaccaggtagtcggccgacgcctcgtccgggccgaccccggccggcgcgtccatcgccaggcgcaggccggcaccccagccctcggtggcgcggaccagggcggcgaggtccaccgcggacagccggcggccgcgcgcggccagcagctcggccgcctcctcgaccccgaaggcgaggtcgcgggcccggatctcggtgagctcgccggccgtgcgcagccggtgcagcgacaggtccgggtcggtgcggctgatcagcaccaggcgcagccggtcggggggatgacgcagcaggccgctgagtcccaccaggatccgctggtcggtgatctcctgcaggtcgtcgaggacgaccacgaccgggccgggcagggcggcgagaccggagccgagccggcgcaggaagtcgggcccctcggcgggcacgaccgggccgcgctgcgggacggactggcccgggcggaccgcgcccgacgtgcgcagggccagcagcaggtcggaccagaaggtgtacgggtcgttgtggtcggccgcgcaggtgagccaggcgatcggtccgctgaccgcgcgggcgccggcccaggcggacgccagcgcggtcttgccccagcccggtccggcgcagatcaatgtcaccgcctgtcgcgttccccggtccagcgtctcggcgagccggggacgccagatcaacccctgcggcgggcggggacgcgccacctgggccggtggcgcggagcctgggcctgcccgcatctggtcccgcatctggcccccagctgtgagatattctggcaaaaggtacacatcacgctgcgtagcttgaagagtgaaccttcgcgcagatcaccccctatcacacgagttacttggtcaccttcggtaactcatcgaccctcgccacccgaccacgcaatcacggcgggtgccggaacagcaaccccccgtatttacatgtaccgagcatttaaccgtgcaagttgcaggtttggcgtggcgagcggcagcccgtccgccacttcatccgcagcgcgggaggcgtccagcagcccccggcggtctgctgaacgtcatgtcgaacagttacgcgagtgaacgtcccgccggcgccgactccccggccccgcccgccacggactggaccggagtggtcgcgttcgccggcatcatgctgatcgccctcggcgtcttccaggtcaccgagggcgcggtggccctccatcatcaggagttccatctggtcagcccggacggcctgctgatcgagacggactaccgggtgtggggctgggggcacctgctgctcggcctgatcgccctggccggcggggccggggtgctcctcggcaggctctggggccggatcatcgggatcctgatcgccttcctcggcgccctggtgcacttcatgttcctggccgccgccccgctgtggtgcaccatcctgatctgcaccgaggtgctggtcatcttcgccctcgccgtgcacggccgggatgtccggcgtacccagggctaaagcagattgagggcccgcgcccggcgcaccgcctcgttgcgccgggacgcggagagcttgcgcaggatgctgcggacgtgcgtcttgacggtgttcaccgagacgtacatcgaggcggcgatctcctcggtcggcagcatctcggccatcccgcgcagcacgtccagctcccgcttgctcagcgcctccaccagcaccggctcggcgaccgccgagcccggctgcggcccgccgaccgcggcgagcttctcgtcgtcgcgcagcacccggcgcagcgtcccccagacctggtggatcggccgccggacgttctccgggccggccacccgcaacgcccggcgcagcgcctcccgcgcgccggtctcgtcgtccgaactggccgccagcatcgccagcagcagccaggcgtccagggccaccggcgccgtcacccctgcggcgtcggcgaccgtgcgggccacctcgtgcgcccggtcggattcgccgcgggccagggccagcgcggcctgcaccaccgcgacgtccggggacggctgcgggcagtcggccagcaccgcggccgcgtcgtccagccggcccgcgcccagcagcagccgggcgcgacccagctcgatctcccggcgcagccaggccggcgcgccggggaccggggtcagcacgttcagcgcgctgcgcagctcgccgcggacctgcaggcgccgggaccggaccacggcgtacgccgcggccgccaccggatcggtgccggcgccggcaccgcgcaggtgccggtcggcggcctcgatgtcgaagcgttccagggccacccaggccagggccacctgggcggcgatcggccggcgcccggccggcagcccgcactgcccggccaggtcgacggcctgtcgtgcggcgttctcggctcggcccagccggccgcggtgcgcctccagcaccgcgagcagtcgcaggcagtccaccttgagtgcctcgtcgccgggcgggacggcggccaccgcgtcggtcagcacctcgaccgcgccggtcacgtcgccggcggcgctgctcgcggtcccctcggcggccagcagcacggcccgcagctccgggtgccgggccagtttgcggatcggcgccacggccaggaacgcggtcgcgaccggggcgagttcggccacccgctccgggtccgggccgccggccagcagcagcagttgcatcacgaagctgctcagggtcatgccctccccgcagtcgccgccccgggtcgcgagcaggttgccggccagcgcgaacagctcacgcgcggcgtccagccgggcgtcgccccaggccagcgcggcccgcaccatcaccacctcgggcaggtcgaggttctcgggcagcgcggcgagcagtcctccgagccgcccggcggtgccttccacgatcaaccggccgatggcgaagtcctcgatcaccagggccgccgcggcgccccagtcgccggcctcgaccgcgtgcccgaccgcgtcggcgagccgtccgttgcgcgacagccagcccgcggcccgctggtgcagcaccgtcacctggtccggttcgagccaggtcagctgggcgcgcaacagttcggcgaagagccggtggtagcggtacaggtcggtgccgtcgccgaccggctggatgaaggcgttctcccgggtcagcgcggcgagcagccgggccgcgtcgggccgggcggtgaccgtggcggccaggtccgcggagaaggtgtccagcacgctggtctccagcaggaaccggcggatcgccggcggctgggtacgcagcacctccccgatgaagtactcggcgatggtcgactcgtcgccggagatggtggcgaccatccgggtgacgtcggcgctgccctgcatcgcgcaggcgcagagccggatcccggccgcccacccctcggtgtgctcgaccagcgcggtcaggtccggcccggccagcggcacgccgtgcagctccatcagccgggccgtctcctcggcggtgaacgccaggtcggcgccgcgcacctcgcgcaactgcccggccaggcggtagcggtacagcggcagcggcgggtcccaccggcccgcgaggaccacccgcaaccccggcgcgtgggcgagcaggaactccaggccggccgcccagtcccggccgggcagctgggcggcgccgtccaggatcagcaccaccggggtgggctgctggtcgatcacggcggcgagccgggcgagcaccgcccggctcgccgcggcgccgggcacggccggttccggagccggcaccccggcgcggcgcagtccctccaggacgtacgaccagaaggtggtcgccggctcgtccccgttctcgcaggtgacccagccgatcggccagggcacggcgcgcgaccgcgcccaggaggccagcagctgcgtcttcccgctgccggccagcccggtgaccagtgtcaccgggccgcggacgccgtcactcacccggtccagcagtcccggccgggccaccatgaacggcggcgcggccgggaccgtgaacttcgaggcgagtagggaaccgtccgcgtcgtgctcagatataccgggtgaatccgcgatcaggtcaatggacacgtctgttctacctccgaggccgaccccgttcgatctcctcgtccagactcccgggggccggcatcgacgcgcatcgtccggatcggataatccgtgaccgtccgcgctggtcccgtcacttcacggctagaacatgcgttccccagggcggcagatcgacgaagagcgcgtcgccctcccggtcgaacacccggccgtccagccggtcgacgagccgccacgcccggcccggttccgggagggtcacccagccctgcgaccagtgatcggcgaagttcaccaccacgatggccgcttcccaggcccaggccagcagatccggggccccggtctcgagcagccgccaccggccgtgtcgcagcggtgcggccgcacctaccacacgtgtgtagaagtcgcgcagttctagattaaactcctcattcggatatctggccagaaagaccggcaagtgggtacgccgtccctcgaactgcccgtcgtgccagagcgtcgccccgggcagcgtcgcgaccaccaccgcggcggcccgcccccgcccgtccgggaaggtcgcggcggcccgcggctcgtcgtggttctccaggaaccggatcagccggttctggtagtccagcccggcgctcagatgcttgcggatcgacgcggcgtcctcgtgcaccagccggtcgtagagccgcttgtcgtaacagtggtcgaaaccctgctgctgcagcgtccactcggtgtcccagtaggcctcggcgaccagggtgacatccggatgccggtcgcgcagcgccgcgatcacctccggccagaactcccgctccggcggcgggccgacgtgctccccccaggtccgcgcgaagatctcgttgatcagcagcatcgccatgtcgcaccggatgccgtcgcactgctcggcgatcgaggagagcgcggccaccgtggccgcccgcatccccggcgcgaacgcgttcagctgcatcacatccggccagggcgggaagtacgggtcccggccgttggcgatcgccccgtccatgtgcacgaaccagtcggggtgcgcggtcaccgccggatggtccggggcgacgtggttgggcacgtagtccaggaacagcctcagcccgcgccggcgcagctgcgcacgggccgcggccaggcccgccgggccgcccagccggtcatccacccggtagcggcgcacgcagtacggcgagccgaccacgtccgacccggccaggtcgggcagcgcctcccggaaggactcctgcagttcccggttggtgcgggccacctcgagtccggccgggctgcgctcccacacccccatcagccagacggcgtcgagcccgggcacgcacacctgatcccacacctcgtccgggacgtcacccagggtgcggcccaggccggccagccagggccaggtgtcgatctcgtagatcaccggattcatcgcggcgccgcaccctccccggagaacttccggaacacgccggccatcccgccggccagcagatcctggccggtcagaccggcgaacaggttggggaacacggcgaccagcccggtccagccggtctggtgggcggcgcccagaccggccccgttgtcgccgtggaagtactcggagaacaggatcaggtctcgccagtgctccgtcgcgaagatcgtttggccgccgtagcacggccgcgcaccgtcctcgccgggcaggaagatccgggtgagccgcgcggacagctcccgggccacctcgaacagggtcatctgctgcccggagccggtggggcactccacggtgaactcgtcgccgtatccgacgtacaggttcagcagcgcgcggatcaccagcgcgttcaccgggaaccagatcggtccccgccagttcgagttgccgccgaacatcccgctgtccgactcggccggctggtaggagacgctgaacacctggtcgccgacgcggaactcgaacgggtgcgcctcgtggaacttcgacagcgcccgcagcccgtacgggctgaggaactcgttctcgtccagcatccgggccaggacccggcgcagccggtcggcgtcgaacagggccagcagccggccgggcccgtcactgagccgcagcgtctcatgccgggccaggaactcctgcgcgtcggccagcacctcgggatgccgatcgatcagcgtccggtcgaagacggtcgtcgcggccagcggcagcagtcccaccatcgaccggacccgcagcgtccgcgacgagccgtcgggcatccgcagcaggtcgtagtagaacccgtcctcctcgtcccacatcgaccggctgccggccgcgatgtaggcgaagtgctcgaagtaggtctgcgcctgctccaggtagaccgggtcgcgcccggccagctccagggcgatctgcaacatgttctggcagtacagcgccatccacgcggtgccgtcggcctgatccaggtggccgccggtgggcagcggggcactgcggtcgaagacgccgatgttgtccaggcccaggaagccgccctggaacacgttgcgcccgtcgacgtccttgcggttcacccaccaggtgaaattcttggccagcttgtggaaggcccgttccagccagtcgtggtcaccctgcccggtccgcgccttctgcagctcgttgaccaggtagcaggcccaggcgtgcaccggcggattcacgtcgctgaaattccactcgtacgccggaatctggccgttgggatgcagatagcgccggctcagcagcaggtccagctggctcttggcgaagttcaggtcgacgacgctgaacgccaccgcctggaaggccagatcccacgccgcgaaccaggggtactcccaggtgtccggcatcgagatgatgtcgtgggcgtccaggtggaaccactcgccgttgcggatgccgggcgcgtccagcggatcccggccgtgctcgatcagccactgctcgacgtcgtagccgaagtactgcttggaccagatcatcccggccagcgcctgccgggccacctgccgctccggctccccgagggcgggcgcgaacaggttacggtagaactcgtcggcctcggcgcggcgcgcctcgacgacctcgtcgaagctccgggaatcctggtcactcccggtggacggacgatcggagagcatcgcccgtacgacgtgggagccccccggtggcaccgtcaccgtgaccaccgcggcggccttgctccccgcctcgccggggttgaccgcctccttctcgccctggatgagccagcggccgatggcgtccttgcgcccgtcggcgttgtcggtgaacagcaccgtcgggtcgcccaggcaggtccaccagcgttggccgagcgagccctgctcggcgcggaccgcgccgccgtcgcggaccagcaacccctgatccgcggtcgcccggaaccacaccgtcggcagcacgtgcagcaccgcctcctccggcccgcggttgtgcacggtcacccgggtcaggatctcctccggcccggccttcgcgtactcgacgaccacgtcgaagtaccggtcctcggcgaagatcccggtgtcgagcagctcgtactcgaactcgccgcgcccgcgcgcccggttgccctcgaccagcccggtgtacgggaactcgtgctgcggatacttgtagaccatcttcagatacgagtgggtcggcgtggcgtcggtgtagaagtagtactccttgacgtcctcgccgtggttgccctcggcgttggtcaggccgaagaagcgctccttgaggatcggatcccgcccgttccacagcgcgaccgccaggcagagccgctggtggtcgtcgctgaacccggcgatcccgtcctcgccccatcgatacgcccgggaccgcgcctgatcgtgactcaggtagtcccacgcgtccccgcccgggctgtaatcctcccggaccgtgccccactgccgttcgctgagatagggcccccagcgtcgccagtcgacggctccgctgtcggcgtcggtgaggcgccgctgttcggcatgctcggttgcgtccatgccgtcaggctgaacatgcccaggtcagcggacgtcccccggaacggatgaaacgccgcccggacagtatccggacggcgtttcgctcgggtcccgcgacctaccgctgggcgcccccgtgcagcgcctcctggagctcctcctcggtctccttcggcagcgacgacttgagcaccgtgccgccgtagtggctcagcgcctccaccgccttgtccggggtgaccgactcgaccaccaggaacagcgcggacgtgcccggctgcagctcgtcgcggatccgctcctggaactccttgttgatcgcgcccttggcgagcttgccggtgagggcgcccagaccggcgccgaccgccatgcccagaaccgggatgaagaacagcatcccgaacagcagaccccagaacatgccccaggtagcgccgccgcccaccgcgtgatggttggtcgagacgtggaacttgccctcccggtcccggatgatcgtggcgatcgcgtccggctggatgatcaggtccttggccagccggttcgcctccagcgacgccgccgtcgccgtggtctcgtcggggtacccgatggcgaccagtgttgccatgacgtgctccttccgcttggtgaggccaagtcagccacggcccggcgcggccatcctcatcaccggcgaatgacttctctcgatccgtccggggcgttcacccgcggcggacgatgcccgggccgcgcggcgcgaccagggtcggaccatgcgcgagcgatacgagatccgggtccggggattcctcgggccactgctccggcggaccctgggcgacctgcggatccgcaccatgccccggcagagcacgatccgtggccggctctccgagcacgacctggaacgtctgctgacccgcctggaccgctccggtgtccaggtggtctgcctgacctcggtgggagagagccgatgagccgctacgactaccagcgcaccagcccgccgccgtcgccgtgggtgggcatggtgctgttcgccggcgtcaccctgctgctgaccggcggcttcgaggtgctggagggggtggtgatgctggcccgcgacgacctggcccaggccaccgcggacgccctggccatcccgctgaacttcaccttctgggcctgggcgcagctgatcctcggcacgatcagcgtgctgaccggcatcggcgtgctctacggccggatgtgggcgcggatcatcgcgatcatgatcggggtggtcagtgccttcaccaacatgatcatgctgccggcctatccgttctggtgctccatcgtgatcgccctggacgtgctctgcatctacgcggtcgcggcgcacggccgtgagatccgcgcctgacacgcgcccggccggcccgcggctgcggccgccggcgccggtcgcggtgctgccccgcggtgtcctcgtcctgctcggcttcgcctgcctggtcgtcgtggtggccgggctgcgctgggtggccggtctgatcggaccggtcttcctcggcctgatgctggtggtgaccgtcgccccgctcaccggccggctgcgtcggcgcggcctgccggtgtggctggccgcggtcctcaccgtcctggtcacctacctgatcctggccggcctcggcaccgccctggcggtgtcggtggcccggctgatcgacctgatgccgcagtaccaggcacagttcgccgccctgcgcgacgacctggtcagcggactgggcgcgctgggcgtctccgccgagcagatgcactccgcggtcgccggggccaccccggacacggtcgtacgggtgatcgggtcgctgttcggcggcgtcgccgggctgctctccaacaccctgttcctggtcgccgtgctgctgttcatgtgcctggacgcggtcgacttcccggcccggctgtccaccgtggtggccgaccggccacaggtcgtcgtggcgctccgctcgttcgcccggggcacccgccgatacctggtggtgtgcacggtcttcgggctgatcgtggcggtctgcgacaccctgctgctgtggtggctcggggtgccgctgccgctgctgtgggggctgctgtcgttcatcaccaactacatcccgaacatcggcttcgtggtcggcgtgatcccgccggcgctgctcggcctgctgcagggcggcccgcacctgatgctcaccgtgatcgccctgtactgcctgatcaacttcgtgatccagtcggtgatccagccgaaggtggtcggcgacgccgtcgggctgtccgcgacggtgtccttcctggcgctgatcttctgggcctgggtgctgggcggcctcggggcgctgctggcgatcccgctcaccctgctggccaagggcctgctggtggacatcgacccgagcacccggtggatgaacgtcctgctcacctcctcctccaccaaggatgaggcgcccggtccggacgcgccgtgacgatggcgcgatgacgacgttcactgtgtggaagtacgacgatccgcagggcgcggaacacgcgttccgcgccatccgctacgcggccgacgacaacctggtcgaggtcgtcgaccacgcgaccgtgagctggccggccggcgccgccgaacccgacacccaccacgcccacgacagcaaccggcagggcgtcggctggggcgcgttctggggcttcgtgttcggcagcctgttcttcatgccggtggtcggcagcgcggtcggcgccggcatcggcggcctcaccaaggcctccgaaggcaccggcatcagtcaggagcagatggaccgcctgcgcgccgagatcatcccgggcacctccgcgctgttcctggtcaccgagtacggcgacctggaccgcctggcggaacgcctgcacgggatgggcagccgcctgatctccaccaacctcaccgacgccgaacgcgacgaactcctcgaagccttcggcgaccaccgcaccgcgtgatcccggcccgcccgggaccaccggccgcggatgcggatccgtccgggaaagcgcggccgggccctcgtcccacccgagtcgggcccggccgccgcgccgacccgggactacctggaaccccggtagcggacatcggcactgctggccttgaagcggcagttcagctgaccccagttgtccacggtcgcgccgttcgagatcagcacccagttgctgaccttgtcaccctcaccgttgcacaccaggtggttctggtagtagccggtggccgtggccggcaggcagtgcgcgcttgacccggtgttgccccaggtcgagtagcagttgttggtcctgccgctggtaccgccactggcgtaggcggcaccggcggtcgcgggcacgaccaccgcgatgacggcggtgacggtcgcgattcgccacccggccgtccggacgcctccggaggcggaccgggtcgggctgtcgctggttgccataacgtgtccttccgttggtgacgaacacctcgctcgtcgttgccgcgatcggatcgccgcggcatctgccccgtttctatgcggcaccgaggacgtcgcctgcggcgacggtctatttgcacgaggcgacgacctatcggcacgctgggtcacatgtcgcgtacggaacgccctcttgatccgtcgtccgggccggccgccgccttcgccctgcagctgcgagagttgcgagtcgccgccggatccccgaagtacctgcagatggcgcgccggaccggccgatccgggactgccctggcggaggctgccgggggcgaccacataccgcagtgggaaacggtcgaggcatatgtgcgagcgtgcggcggcgatccggccgagtgggccgaccgctgggagcaggcgcgtgacgcggcatcccggaaggcccatggcgcaccgccggcgtccgtggcgcccgacccggccgtcggaccggaagacgccgcccgggacggctggtcacatcgccgggacggggtgcttaccgggcggcccatgctgctggcggtggcggcagtggcgctggtgctgctcggcatgatcacgccacggcccggcgcgcttttcgggcgacacccggacaccgccggcgtggggcagatccatgtcgcccgaccggccgcggtgacgcttgtcgccttcagccggttcggcaggttcgcctccgggaacttcgctgtcaccggtgccggcggtgcggtggagatctgggacaccggccccgtcgcgcggcgccacaccctcgtcaccggcgatgagcagatcaccgaggtgcagttcgatccgctgaaccgcgacatcctcgcgaccgccggcaccaacggcctgctccgtctctggaacacgacaaccggcaagtccgtcctcagcatcgcgggccaggcggccgggcacagcatgaccttcgcattcgatccgcgccgccgaggaatcgtcgccaccatcggcgccggcggaacgatccggatcctgcagacggagaccggccggatcgtccgcgaactgcacaccgggctgaccgatgtcaccgccctgacgttcgactgccagaacgagggacacctggccgccggcggcgacggcgccctggaagtctggaacagcggcgacggcacccgcgtcagcgtgggcgagaagataccgggacgggtcacctcgatccgtttcgacccgctgacccggaacactctcgcgatcaccactgccggtgcgccaccgggcatctgggatgccagcaacggccgagtggtgcgcttcctgcgcagcgacgcccgccccacggtgaccgcgttcaacccgctgatcaggaacagcatcgcgacggacgacgggcacggcgacgtacagatcttcgacgccagcaccggcctgccggtccacaccctgcacggtcgatacggcccgatcacctcgctcgagtacgcacccgacggcgccaccctggccgtcggcgcacgggacggcgtcgtcgggctgaacgccgtggacgactggtgaccacccggtgcccggccgcaccgggccgatcagccgaccgggatctccagcacggtgatcccggggtccccggtgcgcagggcgtccgcctcggccgcgccggccaggcggatgccgtccaggtggaacgggtcgatgaacagcggcccggtggacaggtcgaacagcacggcgcgcgccacgccgttctccagttcggactcggcgctgagaaacagggtcacgctccggcagcgcaccgggaagtacgtgctcatcactgtgccggccacactgacgaacagcggccgggtgtcctcgtcgtcggcagcgtcgaactcgtcctcgttgagctcctcgtgcagccgtggccggtcggggccgctgagccgcagtgagtaatccccgtctgccagcaccatggacagccaaccggccggcccgccgagatgggcgtccttgccgaagatcaccgcccgctccggcgggtccttgtccagccaggccgacatcagcatctcgtcgaagacggtgtgccggcgcaacagctcgaccagccatccgggtgcttccgcattcaccccggtgatcatagtgacccggcacggccggtgccggcggcgcgaatcgcggccagggcggcgcggacgcgaccggcgacctgctcgtccgactccaccggcagcgtgacccgccggccggcccgcgtcgatccccgggtcgcgctcgccgccgagaccgcgctgcagggccgggccctgcgccgctaccgcgcctggctcggcgcccgatccgcccactgccccttcggggcgaccgcgcgggcgatcagggtgaccgccacctcgtacgccgccagcaggaccacgatcaccagcagcgccgtccaggacgacaggatcagcgtcaggatggcggccaccaccatgccggcgatgcgcaccgggtcccgatgggcggcgatccaggacggtgcgtgacccaccagccggacgctgccgacgccgatgccacgggcgccgcgcaccacctgggtgcgcagccagcggggcaggcgtccggggccggccagataggcgagcaccgccagcaccgtcccgatcacgatgagctgggtgccgcgttcccgtagcaggctgaacacgctggtgatcgcggcggccgccccgtcgcggtaggtgccggccggcacctgggcgaggatctcccggcggacggcgcgcaggatcgcggtgaccgcgaccgcggcgaccaccagccacaggccgagttgcagggtggtgcgccggcggcccggggagaccgcatacgccgcgatcagcagcacgacggtggcgccgacgaacagcgccaagtcgcgttcggcggtggcgacggcctgctgggcggcccagagccggcccgcgtcgtacaccgtgaactgcgcgaagttcgcgggcaggctgaccccgagctggtcctcgacccgctggcgcaggttgtccgggatggcgccgctgctcaggtcgggcagcgtgatctgcttgccgaacagggtgggcagttcgtccccgacctcgcgcaggccctggttgatcaggggcagcaggtcgatgtcgatccggtcgtggcgcgcggccagcacgtcgctgcggccgtcgaggacggcgagcatccgctggtggacccggcggttgaggtcgatccagatcggctggaaccggccgctgcgcagcacgttgccgatgatcttgcggacctggtcgcggatctgcccggtgatcgggccggccacgaacgcggcctgttgcggcagcacggtgcgcagccgatgctccacgtcgagcacctcgaacagctggctgctggcgtattcggcgaccgccgccgacacctgcgggtcctgaggcagcggcgcgacggtcgcgacccaccgttcggtgttcagcgtggtggtcgccgcccacagcccgaccacgctggtgaccagcgcgaacgcggcgatcgccgcgagcaccgcggcggtcgtgcggcgcagcgtgcgccgttgccacccgggctggcgctgcgggggcggccgctcggccagccgggcgcgcagcgacgccacctcggcccgtagccgggccagttcctccgcctcagcggtcaccggtgagctggacacccggcgacggtctctgaccggggcggtccggcacctcatccggcaggggtgaacggtcccgaagcccggggtttcaccctgcgcggatgaagcccggccgggcccggtgccgcagggtgggcgcatggcattgggcccgctcgaactcatgatcatgtcctttccggcggatcggctcaacgacggcgtgctgacgaccctggaccggctcacccgggccggcgagatgcggatcgtcgacgtgctggtggtgcgcgccgacgccgcgggcgtggcgtgcaccgtcgagctctgcgagctgcccgggctttccggggatctcgcctgggcccggctggcgaccgggctgatcaccgcgaccgacgtcgaggaggtggcgcgtctcgccgaccacgagaccgacgtgctcgccgtgctcctggagcaccggtgggtgaacgacctggccggccgggtcgccgcgtcccgcggcaccatcgtggcgctcaaccacatccccggtgcgcccggccacggacgagtgctgaccagcacgaggtgaggagaagcatgaccaggagacagatcgcgcggcggcgggccgccgacgcgtacgacgtgttgctgggccggccggtccggcccgggtacgggatgctggtggtggtgccgctgttcgcggccgccggcggcgcgctgatcgggctcggggtggacatcctggtgacgcagcggcgtaccgccgcggccaccgcgcagcccgcgccgagccctcgactcgagccggtgagcgcctgatgagcgggctggacgagatgggaccggtcgactacctctgcatcgagttcccgaagggcggcctgcgcggccgtgcgctgccgatgctgctcgacctggtcgaccggcgggtgatccgggtgctggacctgctgttcgtgcgcaagtcgccggacggcacggtggtcgccctggacggacgggagctgcagctcaacgggctgggggcgttccacggcgcggcgtcgggcatgctcggcggcgacgatctgcgcgaagccgggcagattctgcaaccgggtgccgcggcggccctgctggtctacgagaacctgtgggccgcgccgctggcccgggagctgcgcgagtcgggtgcgcagctggtcgccggcgggcggatcccgatccaggagctgctggccgcgctggacgcgaccgaggcggctgccgccccggccggcgggcggtgacccgatgcccggactgctcaggggaatcgcccgcaccgcggtgatcgccggcacggcgaccgccgtctccaaccgggtgtcgcgccgccagcagggtcgctgggcgcggcacgacgccgaggaccagtatctggccgagcaggagcaggagccggtcgaccaggaggatccgatgacggcgaagctggaccagctgcgccggctggccgacctgaaagccgagggcctgctcaccgacgccgaggtcgaggtgcagaagtcccgcattctccattcctgaacttctcaattcctgaacggtaagcgtgcgcaaaagggccggtcggtgatccgaccggctccttttccttacgtcagtacgccacggccagcggcgtggtcgcgtgcgcgagccaccggacgaacccggcgccaccggagtgccgggcccacagccgccgctgccggtccgccccggtgccctcccggcgcagccgctcgaacccggcgtacacctcccccacatcgccggccaggtagggcgtgatcttctcgagcagccgccgcccgtgcccgagccgtccccgggcggccagctccaggtccgcctccacccgggccgacgccaccggcacgatcttctcgccccgccgcacgtcgtcgagcagcgccgcgaccagcgcccggaccaccccggcgagcagcaccgagtcggccacgtccagcccggtgtcaccgatgcgcacctcgatggtcgggtagcggggcgaaagccgggcccagaagtacacgctcgccgcgtcggtcgccatgccggcgtcgacgtggtcgcgcaccgcggcgtcgtaccggtcggcgctgggccacaccccgggcggccggcaggtcggccagcgcagctgggccgggtagcgggagctggcccagccggtgtcggcggcgcccgagtacggcgagttgaccgcgagcgacagcagcgcgcccagccagggccgcagccgggtgagcaccgcggtggccagctcccggtcgggcaccccgacgtgcacgtggcagccgcaggtgccgcccgccgcggtcgcgtccgggaaccggcgggccaggtcccggtagcgtgcatcgtcggtgagcgcctgccgggggccgccgtccagcggcgccgagccggtcgcgaccagcagcgcgccgtcgcgttcggcggcgtcggcggcgatcagccgcagccgggtcaggtcgcggcgcagctcgtccagggtctcgcagacccgggtgctggtctccagctggtaggccatgtattcaggtttgatctgctcgggcagccgcgcgtggcggaccgccgcggcggccgtcggcgacaccgcaccgtccgcggtgagcagcaggaactcctcttcgacaccgatggtgagcacgggcctcatccctcccggacgacggcggtcatggcgatcttgtcgggcaggccctggtgccggcggtccacgatcagccacagcgcgccgatcgggaagtacgccagcagcagcgcgcggaccagggcggccggccagcgcaccggggcgccgtcggcccggaccacccggacgccgagcagggccatcccgggggtccgcccggccagaccccagaacagggcgcagtagagggccagcagggtgggcaggaacaccagataggacgacaggacgaaacgcgcgaggtcgcgcgcctcggagccgaccaccgaggcgaccaccccgagggcgatcaccccggccccggtcagcgccgcgacggcgacggtgtcgatcaggtacgccaaggtccggctgaccagcccggcgtacccggtcatgcggtctcgccgcgccgcgacatccgcagggtgagccggtcgacggcgatgtccccggcggccgcgccggcccgcacccggccgaccgcctcgccgacgatgctctcccgctgtccgcggatcagcgcgcggatccggtccggctcgttctccagcagggtcagcacccgttccagctgggcgtcgacgacccggccgaccacctcggagtggaccaggcgttcgacggcggcgtcgacggcccgctgcgcgccgcgcctgccgcgttcgcgttcggcggcaccccgctcggcgagcagggtccatcgtgcccagagctcggacgccgttcgcaggctctccttgtcgagccgggaccgcagcgtcccgatcgtgtcggcgctcttctcgccggcgcggaacgcggcgccgatcgcgatatccatcaggtacatcacgcgctcccgttccggcggcgcagcaccgccttgcggatctcggtggggatcaccacgacgacgccggcgagcaggcagatcagccagtgccggacgcccaggctgctggtgtgcaggatcttctggaacaggccgaactcggtggccagcacgatcgcggcggcggacaggccggtggtgaccacgaagcgtttgtcgccgaaggtctccagactgaacaccgagcggatgtcgctgcgcacggtcagcgagaaggccaggttggcgatggagaacgcggtcagccccatggtgcgggcatagtcgacgtcgtggccgtggtccgcccagccgatcaccaccagggtcaccgcgcccatgatcaggccgaggatgccgagccagcccagtgcggcgcggctgagcagcggctcgtcggagcggcgcggcgggtgactcatgatgtccgcctcggccttgccgtagccgaggccgaccgactggaagatctgggtggtgaagttcagccacagggtctgcagtggcacgaacggcacgccggcggcgatgttgccgatgctcgccaccaggaacgtgatgatcatcccgaccagggtgcccatctggaagaagatgtacttcttcaggttggcgtacagggcgcggcccagcgcgacggccttgacgatggtggcgaagtcgtcgtcggtgaggatcatcgcggcggcttccttgctcacctcggtgccggtgatccccatcgcgatgccgatgtcggccttcttcagcgccggcgcgtcgttgacgccgtcgccggtcatcgcgacgatgtggcccctacgccggagcacctcgaccaggcgcaccttgtgttccggggtgacccgggcgatcaccccgatgccgccgatctcccggtcggcctcctcgtcgctcatcgcggcgaactcggcgccggtgatcgcgcggccgcggatgccgagcctgccggcgatggcggcggcggtcaccgcgtggtcgccggtgatcatgcggacctcgatgccggccgcgtgcgcctgctcgatcgcgtccctggcctgcggccggggcgggtccacgatgccgaccagggcgagcggggtcaggtcctgcaggctctccagcaggtcgtcaccgagcctgtcgaagtcccggtaggcggtggccatcacccgcagcccctgccgggccaggcgatcgttctcggccgtgtagcgttcgcgctggtcgggcgtgacattgctgcgggcgagcagctgatccggcgcgcctttcacataacaccggatctttcccgacatctcgtggaatgtggccatcagcttgtacgcggcgtcgaacggcagttcggcgatccgcggatacctctcccgggtggcctgagcgtcgagcccacccttctccgccagcacgaccagcgcaccctcggtcggatccccgatcatcgacccgtcggtcaccaccgcgtcggaggccaggatcatcggcagcaggaactcctccagtggcgtgtccggctccccggccacccgtttgatcgagccctgtgtggagtaaccgctgccggacaccacgtaccgccgccccgggatgaccatctcgatcgcggtcatctggttcagggtcagcgtcccggtcttgtccgagttgatcgccgaggtggaacccagcgtctcggtcgaccgcagccgtttcacgatcgcgttcgccttggccagcagctgggtgccctgcgacaggatggtggtgaccacggccggcagaccggtcgggatggccgacaccgcgaacgccaccgccgcggtgaacaccacggtgaactcgttgccccgggccaggttgatcagcaccgaggcgagcagcgcgatccccgagatgatcaggatctggttggtcagcttggccaactgccgggtcagcggggtgtcggcgcccttgtcggtggccagcatcttggagatccggccgacctcggtgcccatcccggtcgcggtgaccagcagttccccggctccccgggtcacgttggtgttcatgtacgccatgtcggaccggtcgccgagcgccacgtccgcctcggccagcggttccacgttcttggcgaccggcaggctctcgccggtcagcgccgactcgtcgatctccagggtggccgcgcgcagcagccgcccgtcggccggcaccacgtcgccggcctccagctgcaccacgtcgccgggtaccaggtcctctgccggcacctcgatcagcgtcccgtcgcggcgcacccgggccttgacgatcatcatcttctgcagcgcgtcgatcgccgccgcggccttgccctcctggtgcaggccgagcgcggcgttgagcagggtcagcgccagcagcagcacgccggtcccccactgtttcagcgggtagaggctgcccaggccggcgaagagcaggaccagctgcatcgggtcggcgtactgccgggcgaaggaccgccaccagggttcccgcttcgcctcggcgaaccggttcggcccgaacttctgccggcgggcgtcggcctccgcaccactgaggccccgctgctggtcgacgttctccgcctccagcgcctccggcacggtcagcacgtgataggtcgcggtcatctcgcgcccctcaccggtaggacggccggggccgcaccagggtggtggccgagcgggccacgccggcgatcaatgagccgatcgcgatgccgaggatcatggtgaggccggacgtgtagaccttggcggcccgttcggcgtcggtgacgtacggcgccagcatcgccgacaccgtggccagcccgaccacccagccgaagaagcgcatcggccgcggggtggtcaggatcagcacatgcaccaggccggtagcggcgagcgcggccaccgcggcgcccagcgcgtaccagccggtgctcgcgtcaccccaggcgccgtcgcccttcggggcgagcacgccgatgtcgaagatgccgcgcccgagcaggatcccggcgacggcgatcagcgccgccaccgccgcggtggccccgccaccggcccacagtttcccggcgttgacggacggtttgacaggttcggagctcatcggattctcctgaggtcgcgggaggtgccgcgcctgagaatcgccgccggagccccggcgccgcctcatccagcgggggtgaatacctccgcggcggccgggaccagcaccacgccgctgcacggccgggccgggatgcgggtcagtgggatggtcagatcctgctccggtacggagtagtcgcaccgagccagtcgggtcgccaggtcggcgagcagcatcaccaccacgtcctctcccgggcaccggtgattggtcgccgcgtcgccgccgccctgcgggatcagctcgtcagcctggggcgagatgcccaggaagcgggccgggttgaaccggtaaggctccgggaacaggtccgcgtcgtggttctgtccgtagatgtcgagcagcaccatcgacccggccgggatgtcgtgcccgccccaggacaggtcgcgcaccgcccggccgccgacgaacggcgcgaacgggtagaaccgccggacctcgtgcgcgaacgcgatggcgtacgcggtgttgccgtcccgcagcggctcggcctgccggggccaccggtgcagcgcgtgcccggcgaacgccacgaaccacgacaccgccaccgtcgggcgcaggatgttcagcatgtcgaccgcgtccaggccgcggatccagctgtgcccgagcagcggttccagccagcgttcccggcggccgcgggcggtccgggcccgccagtgccgcggccccagcgtcgcgaacccgtccaccatcgcggtcaggtcggccgccacccgcggcacctcggcgtcgctgaccggcaccccggcccagtcgcagaccgcccgggtcagcacccggctcgcctcgtcgaagagcaccaccggacggcccggcgtccacccggcggccgtctcgtcccaggcccgcccggcccggtcgaccagatcggcgatgtgccgcgggtccttgagcacgttcaggaagatcgccttgcgggcgtggtgctcgtcgccgtccagggtgtgcacggcgcccttgccgaacagggtgccctgtaccggttccgggagcgccccgtgccgccggatgtgcgactcgtcgtagaagaatcggaccgcctcggggccgcgcagcgcggtcaccttctgcccgagcagccgggtctgcaccaccgggccgccgccggcgcgccgccacaccgtggggagccagccgtacccttggaccgccaagccgacactgtcatcgagaagcatgcgtccccggttgccccggtgtcgggcggacaaacgtcccgggtggattaggaagatccattctgggtagctggagccgcatggcattgaatgagaacgacatcgtgagttccgaccctgcggacaaggacaccgagggcccggccgacggcggcgcgtacccgggtgggcacgacggcggcgcggacggtgccgccgacaccgagggcaccccggacgagggcccggccgacggcggcgcgaacccgctgggccacgacggcggagccgacggctcggcatgaccaccagcgccctggcccgcgccgtcgggatcggcgaggcggagttcgccgacacgtactggggaaagcagcccctgctctcccgcggccgtgccggcttcaccgatctgctgtccgtaccggcggtcgacgagctgctcagccgccgtggtctgcgcaccccgttcctgcgggtggcgcagcacggcaaggtgctgccggccggccggtacaccggtggcggcggggccggggccgaggtcggcgaccaggtgcatgacgaacgcgtgatgcgcctgttcgccggcggcgccaccctggtgctgcagggactgcaccggctgtggccgcccctgatcgagttcaccgggcggctgggcgccgagttgaaccggccgctgcaggtcaacgcgtacctgacgccgccgggcagccaggggttcgccacccactacgacacgcacgacgtgttcgtgctgcagtgcgagggccgcaaacggtggatcatccatccgccggtgctcagcgacccgatcgagaatcagccgtggggcggacacgccgacgaggtggcggcgaccgcggagggcacgccggcgatcgacaccgtgctcgaacccggggacgccctgtacctgccgcgcggctggctgcactccgcccgtaccgagcaggtgcgctccctgcatctgaccgtcggcatccgcagtctgacccggtatgcgctggtcgaggaactgctggcgatggcggtgcaggagccgcggctgcgcgccaccgtggcgtaccgccgcaatccggaatccgagctgaccgcgacgatcgaagcgctccgggagtggctgcccaccgtcgatccggcggcggtggccgcccggatgcgcgagcggaccgggccggccacccgcccggcgccgctgagcccgctggcccagctcgacttcgccgagcggctcaccgacaccgacgaggtcaccgcccgtccgggcctgagcgtcgacgtcgacggcggcaccgtgcgggccgccggctacacggtgaccttccccgggtactgcgagccggccctgcgcctggtcctcgacggcaaaccgcacaccgccggcgacctgccgctcgaccgcgacgacagcctggtcctgatccgccgcctgctgcgcgagggcctgctcacccccgcctgagccgaccggcaccaccgccggtggatcctccgtcagcttgtcattcaacccgtgcggcgcgtgctgtggcggcgcgcccgcggatccggctcgaacctctaccggtccggaccgctcgggcgcaccgcgtggggcacctaccagctgcccggcatcctggccgcggccggcgtggtgttctggctgctgctgcgccgggccggcaaggccacccgggtcgaccgggcggccaagtacatggatcgcggccgcaacatcgacgccctgaccaccggggccgccgcgaccgcgaaacgcctcggcgtcaccaccagcgtcggcctgccgctcggcgcggccctggccggcgggcagaccttgcggatgtcctgggaagacgtcgccgtgcacgtgtgggggcccccgacccggccgccgacgacacgatcgccgaggccctggagtcgctgcgcgaagtggaacagcaggaagcgaccgccggcaccccgtggaccggccaggcgtgagcaacctcggagagtgggacgacctcgccgccctcgacccggccggcgccggcgaccaaccggccaccgggccgacgccgggactggacggggcgatcgccgcagcgttgcgctcgctcgacctgggcgccgcggtacaggctgcacaaaaagcgattcagcagcggatcgaccggatcgtcgccaaggtggtcacgcaggtcgtcgaccaggacgtcgacgccctcgcccggctgcgcaccagcgccgaggaatcggtcgccgcggcgctgaccacggccgccgacacgccgagcctgtactacccgagccttcgccgaagtgggcggtttggctcctgaatgcgatgaatccgcttcaggcggcctcggcgttggccgggatggattcggccctgacggccaggctgctggctgagatgcagccgcgtccggcggccagggtgctggccgcgatggagtccgaccgggcaggttcacttatggagacaatggccctgaggacaccgcacaaggcagttccgctactgactgcgatggacatgaccaaggtattcgacttggtaaatgcgacggcaccgagcctgcggagccggataatgcaggcgacgggtctgcgccaagtgcccgcgctgccgactgaaacagatcggaacacggcacacctcatcgtggccgcgctggcggagctacatacggaacgcccgggccttacctgacacatcaggacggcggcgacgccgagccgcctttaccgataccggtccagggctgcagactcggccggacgccgcctctaaccggcaccggactgcccagttggggcaacagttatggcgctggattctggcgcggcctgcggctgcggagcagtcggtcgatcccgtcggtccggtacagcggtgtacgggcgtcgagccgggtggcggggctcagattcgcacgacgtaccgcggacgtgagggtgttgacgtcgaggtcgtgccgggcggcggcccgcgggatcgtttcggccggttggtggtccacggtgatcgtgacggtgggggcgggcgtgccgaggatctgcacgaaccgtaggtcggcggcgcggcgggcgatcgccggcagcgcttcggtcagggtggtgtggtcggaccagtcgagggccggggcggcccgggccagccgaacctgggcggtgcggacgtgttcggcgatgatccggtcggcgtcggccagtgcggccgactcatcttcggccagagccgcgtcgaagtcgccgtcgaagtactggctcaggctggcctgcagggcctgaaacggctcgacctcggcacccactcccgcatataccagcgggaacgtggcaactgcccccgaaggactgacgaccggctgtcggattcgaagggcgtagcagtaaagcatttggaagatcttggactgtccaccggtgatgctcagcgagaattgcccgggtggtggagggtggatatgcgggcagcctcacgccgtagggggcgcgaggctgcctgctgccgattacttagctgatctggtcggagggttacggtgcccggtcgtcacggtcctcggcgtagggggtgtcgagggaagtcaccgggctagctagctagctgatagcggaccactgaccaagtacgaccagctgctcaccgacggtctcattggcccggacgaccgatccgccgtttggtgcccttctcgtggcgggtcggccgttgagcaatctcaagcaatctcgatgcccgctgaaggacctgccaggatccgagcctgacccgaatggtcgatccatgcttcccacaccaccggcgttccccgagacatcccatctgtgccgcgtttcaggatccgcgcagcgccgtggtggtcttgccggtcctttcccgcagcagcacgcgcagcgtgttcgggtgctcgtagccaaccttgtgagcgatgctctccagcgagagctcggtcgtccgcagcaggtgcgaggctctctcgacccgcaggtcctggatgaaccggatcggtgacgtgcccaaggtgcgctgaacgcagcgctgcagcgtccggttgctgacgccgatggccttggcggcatcggcgatggtgatcgggtcggccagacgcccgcgggcccagcgttcgaaggccgcgacggtgggatcgctctgcgccagggcgctcgagatggtgtacgcggactgcgacggccgctcatccaccacgaggtagcgggcgaccaggtcggccagggccggactgccggcccggacgacggccagcgccagatcgacgtgcccgaaggccgcgcccgcagtggtgaccccgtccgaggcgatcaccatccggctctggtccacctcgacgtgcgggtaccgggcgcggaagaccggtgccagccaccagctggtggtggcccgccggccgtgcaggatgcccgcttccgccagcaggaacgtgccggtgcaggcggaggcgaccggggtgccgcgctcccgggagcgggcgatctggtcccgcaccggccgggaggcggcgccgcccacgtgggcgagcagcatctccggccggcgctcggccagcgcgggcacgatcagcagatcggcttcctcggcccgggcgagtgactcggtgacgacgaggtgaccggcgccggtgcggatctgcggccgaacacccacggtgcgcacgtcccacgttggtgccccgccgatctcgtgacccatcgcgttggcgccgtcgaggatgtcgaggatggccgcgaggccggaatcgaagacgccgtcgtagaccaggaccgccaccttcatgacgcaaacgctatcagtgatggcgttcctgccactgatacgcaagccggagggtggcataggtttgtttttcagcggatatccgaaacctacctattcccgctacccgagtcgcctgccaagaacggacccacagtgaccacgaacctcgacagcccccgatcccggacgcacacctggcggcagccgctgccctgggcgcagctgggtgatctgagcggccgggacctgctccagaaaatcctcgacggcgaagtgccggaaccgcccatcaccgggacgctcgggttccggctgaccgaaatcggcgacggcaccgcatcgttcgagggcgacccgggcgagcacctgctgaacccgatgggcaccgtgcacggcggattcctggcgacgctgctggactcggcgctgggcagcgcgatcgcgacccagctgcctcgcgggcgcgtctacaccaccatgcagctcaacatgcacctggtgcggccggtgctgaccgacacgccccggctgcggtgcgacgccgtcacggtccacgtggggcgcaccatggcgaccgccgaggcacgcgtggtcgacgtggccggcggcaagctctacgcgcatgccaccaccacctgcgcagtcatcgcgtcgagccgcccggcctagtgcgaaaagggacggcatcgctggtcagagtgggtggtgccagcggtggcaacgctcgtgccatcaccccggtggaccagcgttgctgcacgattttgatcagcggctaccctcgctttgtctcaccgtggtcacatcggacacggcgaggaaagtcgatcggcgatacggggagagttgtgaagcgcagaaatgtactggccgcggcggtcgtggcgatgacgtcggtgccgttgacggcaacgcgggccatggcggcgcagacgcaggtggaaacaccggcggaggcggagaacacgttcgtgcgctggctgtccacgcaggacccgcgggccatgatccgcagccgggcccgcgcggcgatcctgtccaccccggccgagaggaccacgttcctggccgagacctacacccgggtgctgccggacatcgcgctgacgcgcgcgcgccagacggactacgcgacccggatggtccgcacccacccggcgatctactacccctgggtgaacgcgaccggcttgcgggcgctggacggcgccgaggccaggatccgcgagttctccagcaccgactacaccgcggccctcaccaaggatcgcgacaaggtgccgttcgacaccggggcggccggcgtggtcgcggaggaccgggcattcgtggccgagctggccgtcagcggcctgagcccggtggcacgcgaacgcgcggctcgtgccgtgacggccggcaccgacgccgacatcgcggagttcctgctgtaccgctgggccatctccgcggaggtggacatcgagctgttccgcaccgattacgtcgccgccgagttcggctggtggacggatgtccgcaaggcggtggtcgcggcggagagcgccgagcagctggcgcgggacgcggtcggggacgccgcggaaccggcccgcgccgcggcggtgcgagcctgggaagcggtcggtgcgcaggcagccacggcgctggccggctgggccgcccaccagaggttcacgcaggtccagatcgacgactggcagcgcaccgcgacgaccgccgccgcttccaccagcccgacctggcgcctgctcaaggtcgacgccccggctgtgcgcaagctctggctcgccgagcaggcgaacgccgcggcgcgcacggcgtggtggaccgcggtgaacgagaacgcgcgcgctcgcgtggcggccctgaccaccccggccgtctgagcccgggcccgcagggacccggcgggtccctgcgggccacggacgatgcgagggccggcgattcccttccgcctccttccgtaacgactcctggcgccccccatcgcgtcggccggccggcggcgtcagcgcgggcaggcctcgcgcagcgggcggacggcggccggaaccggggcgccggacgggacgtaggcggtggtgaaggtgccgtggtagccgaacagcgggccgaagtgccggttcgtgaccttcacccggatgtggaaccgctccgcccgctcgtcccaccactcgtgcacctcggcgtcgccggtcaggaagcggggacagccgacgccgccgcggaacagctgcggaccgctgcgcaggtgcagggcaccggtggcgtcgacggacacgtccaggtcgacggcgaggtgctgggtggtgcccagatagtcgacgatcacgtcgcggccggggtggtagaccatcgtggcgtcgaagcggcggcgccggtgcgggcgtacctgaaaagtccggacgaaggtgagggtgggccggccgtaggtgtcgcggtaggcgtagttctcgatggtgaacgggatgccggcaccggtctccggaaacaggatgtgccgcagcgtgccgaggtgcaggaacggtgcggtgtacgccccgccccgccagacccgctccatcacgccggtaccgacgcagccctggtcgcgctcgccgtcgacgccgaaacgccgctgcagccgggggtgcaggcggccgaagtcgtcaccgagggcgtgctggaagaccgaggtcatcgcgggttctcctgttctgggcgccgccggcaccggcgtgccgcgggcgtgtgggggtgtgggggcaggccgatcgccagcagggccgccaccaggacgacggccgggcgcccgtcgagcaggccggcggtggccaccagagcggcgcgcagcaccagctcgagcgcggtgtacaggcgggcccgctccggggtgatgccgtgctcaagccagagccggagccggtcgaacgaccatgcggtcgcccagccgaacgtcggcccgaagaccagatcgacgagccggccggcgcggccccagcgggtgcggtacgtgtacccggtcaggaagcgcaccccgccgggaaccgggacgtagcgccaatagccggagccctcctggatcggcgaccgccggtcggcggagccgaaccgcagtgcggacaccgccccgcccgcctgctgccgctcgccgctgtgcacgccgtaccccgcgatctcgacgccgggtagcacggcggtggcgtaggtgaacgcggctggcgtgctgccgggcactggatcgatccggccgaagcgtgcgtcccaccgggggtgctgccggtgatcctgcgtcgccagccagacgcgatccatcgacgcggcgatggtcgtctcgacgtagatccttgccacgacacctccctggagtttgagcgaccgctcaaacctagcagttttgagcgaatgctcaatggtggtcgacgttggcttgccggacgcagggcgatgtggccgccgcgcgtccaggacgatcgccgccccctctccatccgctcccggtcacggaacccgtttcgggactcctgttcctccgtgccaggcccaggccgtgatcctgcgcttccacttccccgacggagacgtcacaccccgatcccggcccgagaccgcagccttgatcgaccgcgccttcgccgagcaacgctgctggatccccggcctcggtgccggcgacgagatctcgctcagctggctcgacccggacgacgcaccgtcgcacccggacccaaacccggaccggcaaccggacaccctgctcatccgggcgcgaccgtccggaagtaccgggactcgacaccccgatgggacgtcccggactgggcactgctctccggatcccggaccgtcgccggcctggccctgatcgccgccggcgaggacgacaccgagttcgcctatgccagcagcaacttctggagcaacctccatcacagcctgtgcagggcgaatcccaccccggactggccgctgctcacccggttccgccgcctggaggacaccgcccgccaccgcgaactgacccgcctgcacaccgagccggatgccaccgaggtcgtccgctcggaactggccgcctggtccccgcacgagccggtcctgcgggccgtcgccacggcgatcgtcgacgccgtcacccgccggtgaccgtccgccccgatgtccgggtcagaacggcagtgtcaccgcgtccgacgccggctgaccgggcggctccgtgaagaagtcgttcttccgcgtggtttcctgccgcttcagcttgactgccgcctcgtcgctcaccgcgccggtgagaccgtagatgcggccggtgcgcgaatatttcaggtccgcgtcctcgaccagcactacgtcgaacgacgtcgtccggccggtcagttggcggcgcggatagtattcgacgtagttgttgccgtagtcgacgtcgacgaagaaccagtacgtcagccccggctcgggctgcccgtacgccatcgccttgatcctgacttcgcgggcgcggttgcgggtggcggcgacgtcgtagtgcagatcctcgggtgccggcgccgccgtgacgaccggcgtggtcgtgccggtcgtggtgttcaccgacgacggccccgctgtcgacggccgggcgaagcgcagcgcgaccaccaggatcccgatcgccaccgcggcgacgacgaccaggctcagcaccacgtatcccgccggcatgccgctgttctggtagttcccgcccaccgttatcgagtcgtcgcccgcggaggtcaccgacactccacccgctggctgtcggcgaggctcggccgccgccggtgcgggtccgctgtggtcggggcgggccggtggctcctcggccatccgatgttccagccgggagttcagcaccgccagcaccactccggcgaccaccagcatgaccacgaccgcgccgagcgtccacgacgccttgccgccggtcagcacattggtggccacgccggtcagagccgacaccgcgacgccgacgccggccaggacggcatgctgcttcttcttcgacatgggaggcgggtccaatggtcagccgggtcagatcacctatgcaaccaccgaccccgaccgccgataatcatccacctggatctccgctgacaccgatcatcgggcgggaccgcgactcgtattcttccccaccgcattcgggccgccgacgccatacgaccgtccatggtcgaggccgcacgtcgacgcggccggtgtgtcacccgagcggaacggcgatcccgggcccgggggccggcttctccgcctcgtcgagcagggcggcggccacggtggcccggctgatccgcgccgggaacagccgccggggcacctcgtccagtccggccgtccagcggtccgggctgagtggcccgtcggacagcggtccggcgtggaggagggtcccgcccgcggccaggatgatccgctccgcggtgaccttgtcgtcgaggtcaccgagcatccgcagcagggtgcgggtgagcggcccggccaccgccgcggagcccccggtgccgaaggctcccagccagaccacccggtccgggccggctgccgccacggcgcgcgcccccgcggtcagcgcgccgggccggtcacccttggccacgccgagggccgagaccacgatcggacggtcgcgcagcgcctcggcgatctggtcgggacggccgacgtcggcggcgacccgcagcagtcgcggcgagtccggggcgacgatgcggtgcggggtgcgggcgatcgccaccacgcggtgcccgcggtccagggcctggcgggtcagttcccgcccggtcgcgccggaggcgcccagcacggtgatctcgatgggtgtcgtcatcgcagcggccgcaggacgtcgagggcggcggcatgcacgccgggcgccgcggcgaggtagctgtcgctggtgatctgccagggttcgccatcgaggtcggtgacgacgccgccggcctcccggacgatcagcaccggcgcgatatgcgagcgcaggttgtcgaactgccagtgcacgtccatccgtccggcggcgacctgggtgagctggtggccgaccggcaccgaggcgcgcacgtacagggcgtgccgcatcatcgcggcgaccgccgccccggcgcggtcggcggcggccgcgtcccggccgggtttcgcctgcccggtgccggtgagggcgagcccgagatcggttttcccggacacccgcaccggttcaccgccgagccacgcgccgccgccggcgatcgcggtgaacgtctctcccgccaccggcgcgtgcaggacggcgagcaccgggcggccgtcgcggaccaggctgacgccgatgttccagtcgggcatgccctggaccgcgttcatgttgccgccgaccgggtcgacgacccaccagtcgccgccgggcatcggcccggagccgtgctcgtcggcggtccactgtgcgccgggcagcgcggcgagcaacgccggccgcagggttgcggtgacggcgtcgtcgttggcgcggagcgcggcgaccaggtccgcctcggtcaccggcgtgcgttcggggcgggacacgcgggccgcggcggcccgcacggcggctgtcgccgccgccagaagttgctggtcggaagtcatggatcaacggtgcgccccgacgcggattaagtccagtgcaacgttcttacgctagagtttaccgtcgtgcaattggacctgaatctgctgaccgtgctggacgcgctgctggaggagggcagcgtgaccggcgccgcgcagcggctgcgcctgtcctcccccgcggtcagccgtagcctgggccggctccgccggctcaccggcgacgacatcctggtccgcaccggccgcaccatgaccccgaccccctacgcgaccgccgtccgccagcgggtcgccgagctgctgcggcagagccgggaggtgctcaccccgcgcggcgcgctggatccctcgaccctggaccgcgtcttcaccctgcagtgccacgacgccctggccaccgccgtcgctccggtgctgctcgccgacatcgccgagcgtgcgcccggggtccgcatccggttcctggccgagagcgcgctggacaccgacgagttgcggcacggccgggtcgacctggagatcggcgcgacactcccggccacccccgggatccgccacgagaccgtgggtcacgaccgtttcgtcgcggtcctgcgccacggccacccgcacgcgaagcacctcgacctggcggcgtacgcggcgctgccgcacatcctgatctcccgtcgcggccgcctcaccgacccggtcgacaccgtcctggagacgcacgccctgcagcgccgcgtcctggcgtcggtcggcaccaccgccgcggccgcccacgtcatcgcgcacggcgacgcggtgctgaccgccgcggagctcacctggcgcccactcctgcgggcgttcgagctggtcggcgttccactgccgttctccttgccggctccgccggtcatctgttgctggcatcagcgctacgacaccgacccggcccacagctggctgcgcgaccgggtcagcgccgccttcagcaccgtcctcgccgacgatcaggcacccctcgggtgaagggacggcccgcggcttgatgcggaagccgcggaatgcggctgccgctcgctgtatgcgagccacccccggcggccggacgtcggcgggtaaggcgctggagaatgcttcccccgaccggtatcttcctcgcgtgactgatcatggtgaggtcgacatgcgacgttcgcggccggcgtaccgcgcgggtgtctggctgtaccggctcgcgtttgtcgtcgccgccgtgtacgtgctcgcgatggcaacgcatgctctacctgtgctcagcggcccctcgctggccttcttcccgatcctctacctggcctgcctggtagccggccagtacctgttcgcccaggtcggtatgcggatcttcgcgcttgccctggtgcgcacggacgggccggtcggaaactcggatgaggtccgggcccatcgccggaccgtctttcgggatgtgttcggacgcggtcgctgagcaatcccgctcagcctcgatccacggagggtcggcaagcgaatactgcccgccggggcgggatgtcagccgccgccgaccgcacggtgtggccacccgcgaacggctctaccgatgcatgacccggcgcggccggtcggccctcgcgatgcccgtctcgcgacacctggggccggtcaccacagcggggcagcaggccaccccgatccggtgaccgacaggatcagcggcgccccgacttgatcaccgccaccaccagggcgacgccgatcgccgccacggtgccgatacagccgagcaggagcacgatgtgccagggctggagagcgtccatgatcaaggacggtagccggtccgtgcaccccgggcctctgccgaaagacggttgtgccgccggccataggtcagatagaccaccagccccaccgccatccacaccaggaagcgcacccaggtctcgccggacaggttggtcatcaggtagaggcaggcgagcgccgacagggccgggatgatcggggacagcggaacccggaagccacggttgagctgcgggcgggtgtggcgcaggatcggcaccgcgaccgagaccacgacgaaggcgaacagggtgccgatgctgaccaggttcgccagggaggacagcggcacgaagccggccaccgccgccaccgcgacggtgaccacgatggtcgtccggtacggcgtgccccaccgcgggtgcaccgagccgaccgccgcgggcagcagcccgtcccgggacatcgcgaagccgatccgcccgatcgccacgatgtcgaccaggatcacgctggtcagcccggcgaccgcggcgatcgacaccaggtcggcggcccagccggcgccgacggcggcgaaggccgaggcgatcggcgcgcccgggtcgatgctgcggtagtcgaccatcccgaccagcacgaacgacaccgcgacgtacagcagtgcggagatcccgagtgtgccgaacaggccgaggggcaggtcgcggcgcggccggcgggtctcctcgccgagattggcgacggcttcgaagccggtgtacgcgaagaacacgaccgccgcggcggtgagcaccccggccatcccgtaggtggacggcgccaccccgaacagcagctgggtcagcggccgggccagccccgattcgccgccggccgggtgttccgcggccggcacgaacggcgtgaggttggcgcccttgacgtagaaggcgccggccaccaccacgaacacgcagatcgcgatcttcacggcgaccagcacgttggtgacccgggacgactgccggatgccgaccgtggcgaccgccccgagcagcagggtgatcaggatggcgccgacgttgaccgtgctgctctcaccgaagatcgcgccgggcagatggaacaactgggcgagatagccggaccagccgcgggcgaccaccgcggcgccgagggcgaattcgaggaccaggtcccagccgatgatccaggcgaagatctcgccgagtgtcgcgtaggcgtaggtgtacgcgctgccggcggtcggcacgctggacgacagttcggcgtagcagagcgcggcgagcaggctggccaccccggccagggcgaacgcgacggtgaccgccgggccggcgtggtcgcgcgcctcgatcccggtcagcgtgaagatcccggtgccgatcacgatgccgatgccgaagcccatcaggtcgagcggcccgagccgccgccgcagtcgcgggccgtcgtcgccggcctccgcggaagcctgggcgaggacgtcctcgaccggtttggtgcgcagtacagaatcccggaacgtcggcatgaagcacgcataccccgcggggcgccgggtaagccgtcagcggcccgccgcgtactcccgcatcgccgccgcgacctggtgcaggaaggccgccgtggccgccgcctggtcgtcggtgagctgggcggccgcctgctcaacgcggtcgaacaacggcgcaagggcttccaggacctgccggtacgtctgatccgtgaccaccacgctctgccggcgccggtcggaggggtgtggcacccgttcggcatggccggcggcttggagccggtcgaccagggtggtggcggacgcggagcggatgccgagacgctggccgagttcggtggggccgagcccgtcgccgctggcgatgaggtgatcgagcgccaccgcgtcggtcacgccgatgccgagccgggccgcgaggctgtgcgtcgcctcgccattggcctgcaacatgtctcggatggccagggccaccgggctgggttccacgacaagaatcatacggctcccgggtagcaagaatttctaactacttgtataacaagattcatgaccgcagagatatccccccggcgccgctggctcggcctgctggtggtcagcttcggcgtggcgatgatcatcgtggacgccacgatcgtgaacgtcgcggttccctcgatcatcgacgacctcggcgccacctccagcgacgctcagtgggtccaggagtcgtacaccgtcgtgctggccgcgctgctgctggtcgccggccggaccgcggaccgggtcggccgccgccggctgttcatgaccggcatcggcgtgttcatgctgggcagcatcggctgtgccctggccccggcacccccgctgctgatcgtcgcgcgccaggtgcagggcgtcggcggcgcgatgatcctgcccacctcgctgtcgctgctgaacgccggcttcaccggccgcgagcggggcatcgcgttcgccgtgtggggttccacgatcggcggcgccgcggcactcggtccgctgctcggcggctggctcaccaccgcggtctcctggcgctgggcgttcggcatcaacctcccgctcagcgtgctgattctgatcgccgcgccgatgctgctggccgagtcccgggagtccggcgaccggcggggcaacgaccgggccggcgcggtgctctcctcgctgtccctcggctgcctggtcttcgccctgatcgagggccgcagcttcggctggttcgagcgcaccggcccggtcagcgtggcgggtgtctcctggacactgcggctgtccccggtgccgatcgctttcggactcgccgccgccggcctggtcaccttcctctggctggaacaccgccgcaacgcggccggccgcccggtcctgctcgacctgcggctgttcgcgatcccgtcgttccgcaacggcaacctggtcgccgccgtggtcagcctcggcgagttcggactgctcttcgccctgccgctgtggctgcagaacgtgcgcggctacagcgcgttccagaccgggctggccctgctgccgctggccgcgggcagcttcgtggccagcgggctggccatcccgctcgccgcgaaacggggcgcgatcttcctcgtccggctgggcatcgtgctggaaatcgccggcgtagccggcatcggactcgtcgcggctccggacacggcctggtggcaggtcaccccactgctcttcgggtacggggtgggcgtcggcctggccaccgcgcagatcaccggggtggtgctcgccgacgtgccggtcgcgatgagcggtcaggcgtccggcacgcagagcaccacccgccagctgggttccgcgctcggcatcgcagtgctgggcacgatcctgttcagcacgctcgccggtcacctgagctcggccctcgacgaccgcggggtgcccgcgcagcagcggtcggcggtggtggcggccgtcaaggacagcgcgggcgcggcgatccccggcctggcgggtgatccccggaccgcgccgctggccgcggacgcgaagcaggcactgtcgacggcgacccggtggaccgcgttcaccgccgccggcttcctgctgatcggcctgctggcctcggcccgcctgacccgcaccaccccgggcggtgaccggtgaccgccaccgaccgcaccgcttccccgccgaccgcgccgccgcacgattctccgccaccgcaggccggcgtcccgtcaccgaccgcgccgccgcacgatccaccgccaccgcaggccggcgtcccgtcaccgaccgcgccgccgcacgatccaccgccaccccaggccgtgcccctacggaccgccacctcgcctctggacagtgcggatctccggagccgggtccgcggcgtgatcgacgacttcctcagcgcgcaacgcgacgtgctggccgaggtcagcgacgactgcgcgccgctggaacgctacgtggccgacctgatgggcggcggcaaacgactccggccggcgttctgctactgggcgtggcgggcggccggcgcccccgacggcccgggcatcgtggcggccgcgacatccctggagttcctgcaggccgccgcgctgatccacgacgacatcatggacgattcggacacccgtcgcggcgccccggcggtgcaccgcagactggcggccctgcactccggcggccgctgggccggggacgccgaccacttcgggctgtccgccgccgtgctcgccggcgacctgtgcctgacctggagcgacgcgttgtattcgggcagcggcctgcacccgtccgcgctggcccggggccggccggtcttcgaccggatgcgcacccagctgatgggcggccagtatctggacctgctggaccaggcgcggccgtcccggggcggcgtcgaccgggcgcgccgggtggtgcacttcaagagcgccaagtacaccgtcgaacatccgctgctgctcggcgcccggctcgccggcgcggacgacgatctgctcgcccggttgtccgcgttcggtctgccgctgggcgaggcgttccagctgcgcgacgacctgctcggggtcttcggcgacgcggcgcagaccggcaaacccaccggcgacgacctgcgcgagggaaagcgcaccacgctggtcatcctggccgcggaccgcgccaccgcaccccagcaggccgccctcaccgcgctgctcggcgatcgcggcctgaccggggccggcgtcgacaccctccggcagatcatcgtggacaccggtgcccgggccgaggtcgagcggatgatcgagcaactgctggcgacgagtctcggcgtgctcagcggcacgcccgtcgacgaggcggcccgctcggtgctgctcgccctcgccgaggcggcgaccgcccgcagctcctgagcggtcaccgacactcagcggtcaccgaaaccgggcggtcaccgaagctgagcggtcaccgaaactggcccgtcaccggcgccgggcgagcaggccgccgatgcccgggacccaggccagcagcttcgcggtgcggctcgccctggcgtcggtcgcggtgctgacgatgacgaacaggtaggcgcaaccgtggatcggaccgcccagcgacgtgaccggccgggcgtgcacggtggccagattgatcaggagaatcagcagcgagctcagctccacggcggcggcgacgccgcggtatcgtgccggcatcgctcaggtccccgtcgtcgagccggggcggacgaccatcagcaccacgaccgccgcccagatcaggttgaagacaccggtcagcatcccgagccgggccggcgggaccgccgcgccggcgacgatcccgcgctgcgcgggcaggatcaccagggccagcagcagcccggcggccgcggtcaacccgatcgaggtcagcagccaggcgtcgccgaggaccccgaggcgggacgcggtggccaggccgaagaccgggacggccagcccgagcagcgcgtacatccggcagatccggtgcagcagcggcagcgccccgcgatcggcgcgccgggtggcggcggggaacatgctggcggcgacggtgaccggcccgatcgccacgagggcggccaggacgtgcacgctgagcaggagttttgtcacgcctgcgaacgttagggccggatccgcccggacagaactggcgagattgcccaccttcaacgagatctggccaggagggcgttagagtgccgggatgcacctcgtggcggtcctcgccctggacaccgtgatcccgttcgacctcgccaccccgatcgaggtcttcggccggaccggccacggcgcgctgtacgaggtgcggatctgcgcgcccacctcgacggtcgacgccggcgccttcaccatcaacacccggtacggcctggacacgctgctggaagcggacacgatcatcatcccgggctgcgccgacaccgccatgatcgtcccgccggaggtcgtcgaccacctgcgcaaggcggccgccggcggcgcccggctcgcctcgatctgcgcgggcacgttcattctggccgcgaccggtctgctggacggcctccgcgccaccacccactggctggccaccggcgcgctcgccgcccgctacccggagatcaccgtcgacccggacgtcctctacgtcgacaacggccagtttctcacctcggccggcgccgccgccggactcgacctgtgtctgcatctaatcaggcgcgaccacggctccgcggtcgccgccgacgccgcccgcctgtccgtcatgccactggagcgggagggcgggcaggcgcagttcatcgtcccggcgcagccgcctgccccgcgcggctccgtcctcgaaccgctgctgcgctggatgcaggactgcaccgatgtcgaggtatccctcgccgacctggccacccgcgccggcatgagcgtccgctcgctgaaccggcacttccgcgaccagaccggcaccaccccgctgcagtggctgctgcgcgcccgcgtccgccaggcccagcacctgctggaggccaccgacctgccggtcgagcacatcgccggccgggtcggtttcggctccccgaccgccttccgtgaccgattcaagcgggtcaccggcgccagcccccagtcctaccgagccgcattccggacccgtccgcgcccgtagccgggcccgccctcgacgtgcccgctcggatcgagcgtccatcgaagtccggaccggtttggcaccggccgacgcccgcgtcgctattcggcgccgccgtccgccccgccgtcctggccggccgggttcgctccgccgtcggcgagcccttcgccgtgcggcttctccttttccgcgccgccgtcggccccgccgtcgcgccccagcgggttcgccccgccgtccgccggcccttccccgtcctgcccggccgggtcagagctgatgatttcctgctcgttgagtgccatacgctggggcatacccccaaaaaagggacttaatcccgacgatcaggaagaccaccaacacgttcaccaaccagttgccggtacgcgtgtagaccgtcccgcttccgcccggccggctgatcgatcggcacaccgtcgtcgggctggtcacctacgagtcggtcctggtcgtcccggctcctgaaccgcctccgctcagctcaccgcgtactcttcgtgcgccgcgccggtggtcgccgggtccggcacaccgacgagtccggccgtctccagttcgaggaagaggtcgaccgcgtccgggtcgaactgcaccccgcggcaacgacgcagctggtcgcgggcctgctcggcggagagtccggcccgcccggcgcccgggcgtcgcatcaccgcccacgccgcgcaaaccccgatcagcaggctggtcggcaccaccgggtcggcggcgcggcagcgggcggcctcggccaccgtggccgtccatcgccggatctgctcgtcgggaccgggtgcgccggcggggtccgggagcacggcgtcccccgtggcgacggcgtgcccggtcccgcccacgacgacccggttgcgcccgccgcgcttggccgcgtacagcgcggcgtccgcggcgctgagcagttcttcggtgccggccccgccgggcagcgcggcggcgccgacggagacggtgaccgggatcgccgtgcggccgttgaccaccaccggcacctcggcgatccgctcgcgcagccgctccgcgagcgtggccaggtcggcgtgatccctggtcaccagcaccgcgaactcctcgccgccgaaccgtgcgacgacgtcggtgccgcggcaggcccggcgcagccggcgggccagctccacgaggacctggtcgccggccggatgaccgtacgtgtcgttgatgcgcttgaagtgatccacgtccaggagcagcatcgcgatcggggtgccgcgccgggcggcccgatcgccctcggcgctcaacgcctcggacaggaagcggcgggtgtgcacacccgtgagaccgtcggtcatcgcgatccggcgctgtgccgagacgagagccgccatgcgcgtgaggaccagcaggaacagcaccgccgacgcggtcaccacgacgaggtccgaactcgtggagtgtcgcagatcctgcaccagcaggaccgccggagccatcagggtggcgagcgcgagcagcgccacgcggttcagggtcgcccccgaccgggtctccaccggctcggcgatgtgccgcatcgacggatgcagggcggacgcgcccagcgcgacgtaggcggccaggtacacggcgtccgaccagccaccgttcacgtacacctcgtgcagcgacagcaggccgtacgcggtgtcggccagcagcgtcagcccgaggttgatcagcagcagcaggtaggaccgctgccgggtgccaccgccgagcaggagccggatcgccacggtgagcacgcacaggtcggccaccggatagatggtggcgcccagagcatccagcggggacgaacccggcacggcgacggcgggatggatgaggaacacccaccagagcaccgccgcggccaccgtgaggatcgccgtgtcgatcatcgcggccgtgttccgctgcggtgagcgccgccggccgagcagcaccagcgccgcgccggcgaacccgtactgcgagagatagagggcgttggcgaaaaggggatagccgttcgtcccggcggcggcggtggccgtgaaataggcgatgtccccggcgacgtacatcgcctggccgatggcgagcagccaccacacgacggcgttgcgcggccggtgcagccggatgccggcggccagagcgacggccgtgccggcgctcaccgcgcaatacagcaccgactgcgcgacgggatgcgtggccggcacgatgaagtgggcggcgatgagtgccaccgccaccacgcaccacacctgccaggccaccgaccggagccggcgggcaccggccgggacggtccgctccgggcgcctgctccagcatgtcaccgggatatgtcaccaccgtcgcggtgacagccggttcgccgccggttgcgattcgggtgcggtttcgccgggcgccgccggcgcagcgtctccggtacggcggtgggtgcaccgccgtaccgtcagcagggatctcagacccggcactgccaggagcgcgcgtcgaagaagtcggcgaagcggtcgacggtggcgtagccgaacgtcgtctcccggcaggcggccagcacgtcgatggccgagcgggtgccgccggtgacgcagtgccagtcgtagaccgtgccgccgtcgagcgcggcaccgtccgcgccgcgggtgcggcagaagcggtcgaagtccggcaccaccacgtcggaacggacccgccagcagccgatgctgtccgggcggtggaagtcaccgatccggtcgatcgccaggtcgatgccgtaggtccagcggcaggcggcgtccagggcgatgtcgtgcccctggccgcagtgccagtcgtacgcggtggctccggtcaggacggccccggggtagccctgggaccgacagaatccggtcaggttcggcgcgcccaggtcccgcggcggggcggggaggccgcggcgggggcggcggtgccggccagggcggtgacggcaccggtcagcagggtgagcagaaggcgtaccagggtgcgcatggggttctctctcgacgggatgccgggtggatcaggcgacggcgtacacgtagttggcgccgaagtcggagtcgtaggcggtgcagccgccctgatccgcggtgacctggaaccagatctcgacctggtggctgccggcggggatgtcgatgcttcccggcacctgggaaccgtcgccggtggtcagggtctccgactgggccggcccgccgtcgaagcggcggaagacgtcgatgcgccaggcctggtcgcgacactccggaaggcgggcggtgtcgtagcgcagggccagccggtggcccgcctcgatgctgccggtgaccgtctcggaccagtcggcgcggaaggtgacgacggccggctgcccgatcgggtagtggtagttggcgccggatcgggagtcgtattcgctgcacccggcacggtcgccggcgtggaaccacagttccaggtcgtgcccgccgggcggcaggtcgatgccggccggggcggtgacgttgtgccggttctggtcgagccgggtgaccggccgggtctggatcgggccgccgtcgacgcggtagtagacgccgatgctccaggcgtcgccgccggcgtactggttgcggcattccggcagccgggacaggtcgtagtcgacgatcacgggccggccggcctcgatggcgccgtcgacccggtcggtgccgtcagccgcgaagtgaatcacgggcgcggcggtcgagggcacggcggtcgagggcacggcggtcgaggcctgggccgggccggccagcgcggccagggtcgccgcgctcgccaggatgatgacggcgatggtgcgaggcatcgtgttcccctcacagatcggtatggtggcgccgcgaatcgcggcaccactgccgacactgcaagttcttgcagaagcagtcaataaccatcatcaccttaagtaatcgaaatcgttcaccatgtcataagcggaagcgattcgatgcagctcaccggtgctaaaacgcgacagataagaacagtgtgggcgtcatcacgccaacggacacccggtgagaggatgcaagaaatttcatgacgcacggcccccgccgaggaggtggaggccgtgcgaatgtctgcggcgacggatcggcggccccgcaaggccgccgatccgtcgcccgaggctcagccggccacgttgaccgcgaaggcgaccaggttggcaccgtcggtctgggccggacccgcacccagctggacccgggtggtgacggtgccgagggacccggccgccgtgccctccggggcccgcacccgcaggtcgtaggtctgcgtctcgccctcggcgatccgcacgccgaacaggtcgcagccctcgccggcgccgccggccgggatcggcaggtcgtcgctggatccgacgcacgggccgctcgggtcgagcatcggccacgggctcacgcccgccggggtgatgatgtccgcgtgcagccacttgtgcggggcgtcgccgtcgctgtggacggtgatcggcaggtgtccggcgaaggtgccgtcctcctgcttggtcagggtcacgccggcgtccgcggtcaccgtcagcttcgactcggtgtcctggtggtagacgcgcggacggctcaggctgccggtggtggaccggaacaccgcgccgtacctgaccttgctgccggcgtactcgacggtgccgacgttcggggcgatctgcgcgtacttctgcggcttggcgggcgacgtgaagccgatcgtgacggtcccgctctgaccgggctggatggtctgctccaggccgcagtagtcggtctcgcggccgtccgggccgacgtccagggtgcagccaccggccccgtcgaaggtggtgaacgaggccgggagcggctcggtgatggtcagattgccgccgctgaccggctggtccgtgccgttcttgatgacgatcctgatcgtgccggtgtgcccgtaccggccgggctccaggatcagccggtcgaccttgacggtcaccttcccggtcgtcgccgcctgagcggtgacggcgttgcccagcagcagggttccggccgcgagcgcgacagcgcccgcacgcacgacagtgcgcatgaatgatctcctcagttcgattccccgtgcagccggtccagatcccggctcatcgatgaaaatgatcctaagtagatcgacgtccgggcatctcccggatttgtgccaccatcatcggaagtcggcggcgtggtcgacggcccactcggcgaaggtgcgggccggccgcccggtcacctgcggcaccacggtggacgtctccgcggccgcccccgtcgaccagttgcgcaggatcgcggtgacggcgaactccggcaggccaccacgcagcatgtcggcgcgggcgacctcctcgtcgacctcctcgacagccaccgggcggcccaccgccgcggcgatcgcgccgacctgccggcgcagggtcagcgattccggaccatggacggtgtacgccatggcggcgtgcccgtccgcggtgagcgcggcgaccgcgaccgctgccaggtcggcctcgtggaccggggcggactgtgcctccgcgtacgggagccggacccggccctgctcccggatggacgggccccacaggccgatcgcgttgaccgcgaacatcccgccgcgcacgaacgtccactccaggccggagcgctccagcacctcctcgaccgcgcggtgccggcgcgcgatcgggttctgggcggcgtccggcctggtcacggcggcgctggagagcagcacgacacggcgcaccccggcggatcgcgcggcggcggcgaagccctcggcgccggccggatgagcgtacgcgaatgccgccccggcatcggccagcgccggcccgagagtctccggacggtccagatccgccgccaccgtctcgacctcggggccgaaggccccggcgggcgcctcccgacccgtcgcccgcacccgctcccccgccgcccgcaacccggcgaccacctgccggcccacccgtccgcgggccccgaacaccacgatcgtcatgccgggagtctgcaacctgcacctcggttgaggtcaagaccggccgggcggcatggcggaatgtccactatggccgttaggatcgtcccgacgcagccgatcggaggacgctggcgatggcagacgacggggacctgtccgcacggatcgacaccacggtgccgcacccggcccgacggtacaactactggctgggcggcaaggacaacttcgccgtcgaccgggcgtccggcgacgagatcgaggcgaaattccccggcatgcgcgccggtgtcgtggcgaaccgggacgtgctcggccggatcacccgccacctggcccaggacgccgggatcggccagttcctggatatcgggaccgggctgcccaccgccgacaacacgcacgaggtggcgcagcggcacgccccgcacagccgggtgctctacgtcgacaacgatccgatggtgctcacccacgcggccgcgctgctgaccagcgacccgcgcgggcacacccggtatctggaggccgacctgcgcgacccggagaagatcctggccagcccggagctggcggccaccctggacctgtcccggccggtcgcgctgatgctgatcgcgatcctgcacttcctgcccgaccgtgcgcaggcccgggcgatcgtgcggcagttgatggacgcgctgccctccggcagctacctggccgtcacccacttcaccaccgacttcctcggcgagcagcagcgggccacctaccgggcgatgctcgacagcggccgcagcgacgcctggccgtgcacccgggacgagttcgccgggctgttcgacggtctcgacctggtcgagccgggtatcgcggtggccagcgagtggcggccggcccccggtgcgggggccgtcgacccgtcgctggtcagcatctgggccggggtcggccgcaaaccgtgacgccgcgccgcggcccgctgcgggccgcggcgtcgcgccgtacgcccatcagtcctctgcctggtattcctcgaccttctcgaccggccagccgatgaattccgcgacctcgtcggcgtccgcggtcagcacccagtcctcgaccgcgttcgccagcccgtcgggcaggcccggcgtcgacacgtactccaggtcctcgtcctcgaggatccggtcatggtggatgaacttgtcgtccgggtcgaggtccgcggcggccgcctcgtactccggcaggccgccgtcgccggcggcgaggatctcgctggtccgccagtcgatgatgtcccagccgtcctcgccgatctgaccgccggtgatgatccggtggccctgcgcttcgaggtcctcgatgcggcgccgggtctggttgaccgaggcgaagttggcttcgagcacgctctggacgtgctccttgagaaggtcgctcacggggcgtgagcatagagcgggtgggcaaccccgcaccattcgacatccttcgaccgcggtctacggcgccgtcgcgcgcgtgccggcgtaggcgcgcaggaacgcccgcaccccctcggccaccagcgatcgcacccgctcgtcagcggtgatcagcgtcgacccgtgccggttgagcaccaccccgaacgtgagcgcgatcaggtggtcggcggccagccgcggatcggcaacggtcagcagcccggcctcgccgagcaccgccaaccgctcggcgagcgcctcctcgggtgcgtcccggaacggcgcctcgctcaggtgcccctccccgcccagcagcttcagcagcgtcgcatagtcggccgagccgagcatgtcggtggcgatccgcatcgagaaaccggtcagcgcgtcctgcagctgggccggctcggtcagcccggtcagggtggcgtcgatggtccggcgcaccgccgccaccagcgagtcggagatgtccccgaccaccgcctgcagcagcgtgttcttgtcaccgaagtagtcgtagacggtccgtttcgacaccccggcgcgggcgctgaccgcgtccacgctggtgcggtcgaatccgtcgctgaggaacagctcgcgggcggcggacaggatcgcggcccgtttcgtcgcggacccctcgcgcagcggtttggtactcggcacccgcccaccctacccgaactacactgcacggtgtagtttacttgtcatgaaggcactcgtctccggcgccggcatcgccggccccaccctcgcctactggctgcgccgccacggctgggacgtcaccgtcgtcgagaaggcaccggccgtccgcggcggcggctatcccatcgacgtccgcggtaccgccctcgacgtgctcgatcggatgggcgtcctgccccgggcccgcgccgcgcacatcgacacccggcagctcaccttcctcagcccggacggccgggtcgccggccgactgcgcccgcgcaacctcagcggcgacggtctcgaactgccccgcggcgtcctcaccacgatcctgtgcgacctggtccgccacgacgcccggttccgcttcggcgactcgatggccgcgatcgacggccgccgggtcaccttcgccagcggcgcgcaggaggagttcgacgtcatcctcggcgccgacggcctgcactcggccacccgccggctcgtcttcggcccggaggagtcgttcagccgtcacctcggttacgtcttcgccggcttcaccctccccaacgacctcggcctgcgccacgagggccaggtctggtcggcgcccggccggatggccaccctctacgctccgggttgctcggacaccgtccacggcctactgatgacccgcagccccgaaccaccgcgcgacggcctgaggttgctcgagtcggccttcgccggcgacggctggctggtcccccggctcctcgacggcctgcgcaccgccggcgacgtcttcctcgacgtggtcagccagatccacatgcccacctggtcacatggccgggtggcgctggtcggcgacgccgcgcacgccccgtccttcttctccggccagggcaccagcatcgccctggtcggcgcctacgtcctggccgaggaactggccacacacgccgatcccaccgcggcgttcgccgcctacgagcagaagacccgcgattttgtacgacgtaaccaggcgctcgccgatggcggtggcggcacgctcgccccggactcggcacgcgccctgtggttccgcaaccacgtgctgctcaaggccgctccgttgctcggcgccaccggcctgttgggccgcagcgtccggcacgcggcgaccgccctgcgcctgccggccccggtccactgaccttcgcaccggtcgcggtagtagtcgccctggtggaccggcaggcatcgggttcgtcagcgcatcggcgtgcaccgggcgttccgggccctgcctgataaatcacagtacgtcgctatgggtcgctgacgtgcgaagacatcttcgtatcgacgggctcgcgacggcgatcgatgtgaaccggtgcacggggtcttgcccgccgtgtggtcggccaggttggctcggcgcatggcactcatcgcatacgacaacgagcaagcggcggccttcgaggagacccggcatctgcaagacgatgacctcgcgacctggcgtgccgcgatcggccggcacttcgagccccgctccggggcgcgcctgctcgacctcggatgcggcaccggcagttgggcccgggcgttccggacctggtggcccggcgtcgaagtgctggcggtcgagccgtcggcggcgatgcgggagcgggcgatgttccagcccgtcgcggccggcgcggccgacgacatcccgcttccggacgccagcctcgacggggtctggctctccaccgtgatccaccacgtccccgacctggaggccgccgcccgcgagatccggcgggtgctgaagccgggcgcaccggtgctgatccgctccgcgttcgccggccggcacgaagcgatcaacctgttccgctggttcccggaggccgtcgccgtgctggaccgctacccgagcatccccggcgtcgaggcggcgttcgccaccgccggcttcgcgacgaccggctgcgaaccggtcccgcaggtgaccgccccgtcggtggccgatgccgccgccgccctgcgacgcgaggcgcacacgccactgcagttgatcagcgacgaggcctatgccgcaggcgtggcccgcctgcgggaggccgcgcgaaccgagtccggcccggtcgtcgacgccctggacctgctggttctccggtgactcttcgaccgacggtggtcaccgactctccgcagttgtcgaccgctgcccgagggcgccgtcagaaaggacactgagccatgatcatccgggagtgccgcgaggacgacatcgtccagttggagttccaccacccgtctcccggacggactcgccgcaacgaagcgcgcttccaccgccaacagcagggactgagcacgttcctgaccgcctgggccgacggcatccccgtcggagccggcgacatcctctggcagggatgcgaagccgccgaggtccacgaacgctaccccgactgccccgagatcaacggcctggccgtctggcccgccgagcagcagtcccgcggcatcggcaccgccatcatccagacagccgagaccctcgccgcccgacgcggctaccaccacatcggcctcggtgtcgacgaccagaacccgcgcgcagccgcgctctatcttcgcctcggcttccaggacatcgactgccactacctcgaccgctaccactacctcgacgatcacggcacccgccacgacttcgccgacccctgccggttccttgtcaagccgctccggaacgggcccggccgatgaccatgaggaccacgaacgacgacccggacgcgggatcgggctgccggcgccgggcgtctaccctgccgccatggtgatcagcattctcggctgggtggcccggcggcgactggcggtgctcaccgcggcgttgctgaccgcggtcgccctgcaggtggttctgcacgtcaccgggaccgtcttcgccccgtgggccagcttcgcggtctacgcgctgccacccgccgcgttactgctgtgcatggcggtcgccatccgggtccacgacgcggcgcacctggtggcgcggcccgagattcccgccttcggctccccgccgaatccgaccctcgtgctcggcgcggcatgcctgacctatctcgccgtctacggcgcggccggcggtatccgcagcatcgagccgcacccggacctggggcacacgatcgtcagcatcgcgctgtacctcactgagttggcggtcttctggtgggcgtcacggctgcgcaccggcatcagcatccgcccggacggcatcctcgaccggcagcccttcggcgacctcttcatcccctgggacgcgctggccaccccgatcgccgcccagccgcacgacgcccaccgggtgacgctccacctcgcccacccggacctgacccgcagacggggcctgcgacgcggcgccccggccgccctgtcggccgcgggcgtcagaaccgacctgctcgcctggatgatcaaccactacgccgaccaaccggccgaccggtccgccatcggctcaccagcggccctcacccggttcctgctccccctcgaccgactggccacgcccgaggtggcgaggcagccgtaagggcgccggtgggaccgtgcggggaccggtccattagcattccggcgtgaccgactggcgtgccgaccggacaggttcagcgttacggggacagaatccgaccgttctcgcccgtctcacggccggcttcgcggtcatcggcgactcccagttcctccccggatactgcgtgctgatcaccgacgatcccgccgccgaccgcctcaccgacctgccccgcccgcgacggctcgccttcctcgccgacatggatctgctcggcgaagccgtggccaccgtgtgccaccgacacgacccccggttccggcgggtcaactacgcgatcctcggcaacctcgacccgttcctgcacgctcacgtgcatccgcggtacgactgggagcccccggatctgatcaacggcccggccacccactatccggccgacttccgcaatgccgcggacaacctcctgggcccgcgtcacgacgtcctccgagccgacctgaccgcagaaatccaccggctcgcatcatgatgcggcccgcggcatctctagaattgccggggtgtccgacccactgcgccgctccgcccgcgtgctcctgctgagcagcaccgaccgagtcctgctcctccaattccggttcgaccccgcggacgccgcgaagggccacggctgggcgactcccggcggcggcgtccaggacggcgagcctctcgcccaggccgcgacccgggagctccacgaggaggtcggcctcaaggtcagcccggaagtcctgggcgacccggtggcctacacctccggcttcgccgacctgggctgggcgagcggcatcttccgtgacgagttcttcgcgcaccgcgtcgacgaccacgaggtcgacaccagcggcatggaggaccacgaacggggctaccacgccgggcatcgctggtggacggtcgacgagctggccaccaccaccgagaccgtctacccgttcgggttggccgatctggtggaacgcctgctcaccgagggcaccccggcacagcccgtgcagctgccctggcaccactgaccatcgctatccggccccggtgtccgcgccgggacaccgggcctcgcgatgccggcgccacgcggagatcaccgggtccggcggtccggagtgccggaccgtaacagcttcggggcgcggtttccggggtgaacggtgaccggccacgggcaatgaagggtgcggcgatcacccttggacgcgccagcggccggatcgccgcgcccggcctccgcgggagcagcgctcagttgtcggccgcagccggggacatcaagagggtgaatctgacctgatgagtgccgccatggcgtcgacctccgacgattgttcgttgaggacgtgtttggccaggctgtggatgtacgggttgccggacggcccgtccagcagggagcgggacatcgtgatcgcgccccggtggtgttcgatcatcaagcgaaggtagacgttcggcgcggcgtcgcggctggcgtgatcgagttcggtcagctgggccggggagagcatgccgtgggcggggccgccggcggacggggaaggctcgttccaggcgctgagccagtcggtggtctcgtcgatctcgcgctgctggtcgtggatgatgtagtcggcgatcagccggacgcgttccgggaccccgcccttggcgagcagggtgcggctcatggcgaccgcctgctcgtggtggtcgaccatcatctgggcgtagtggacgtcgatccccgacggggtggtctcggtctgcgcggcggccgcctgcggggccgggtggtcgccgaggcgcaggacgaagacggtcgcggcggcgagggccaggacggccgaggcggcaaggcggcgaacgatcacaagcggtctccaggaatgagagaggcccggcccgggatgaccccggaccgggccggacctactgggggtcagccctgcgatccgtcaccgctggtgttgccgttggcgccggccaggccgggcggcgtcagcgggttcatctcggtgaagtcgcggggcagcaggtcgaagccctgccagtgcagtggcatcgggctctggtcctcgtcgcgcgggatgtggtggaagccgacccggacccacatgaccgggtcggtgagcttctgcttgtccttggcgaaatcgatgatggtcttcttgtcgagcgggcattccgggtcggagttgttgtcgctggcccacttctcgcaggcgtccttctgggtgaaggtgacgtccggcttggtctccgggtgcccctggtactggtcggtggcgccgagggccagctcgtacgaccgctggtgcccgtccgcgttcttgctggtcgggctgaccagccgccaggaccgctggttgaccttggtgaaggtgccctcgttggtgacggcggtgcgggtggtcttcagcttcgcggtcacgctgccccggccggccgtggtcgtgtcgagctgctcgaccttctcaccgccctttccggcgatgttgaagtcgacccgccagaatgcgttgtggtagtgcatggtggcgtagtccttggccggccccttgccgatcggccagccggtgctgctggtggagtactcgctcggggcgaggtcgccggtcgcgccgagccgggccgtgatctggccgtcgtcgtgcagacggtattcggtgacgtactcgtaccagccgagcttgctgaccgtccgcagcaccaggtcgtggccctgctgcgagtacaccttgtcctgcggctccgcggacgggccggcgccgccgtcgtcccaggagtgcaggcggtaggcgaggccgcgcggctcggcgctgacgcacaggaccttgcggcgctgcggctcgctgctgccgtcggagccgagccggatggagccgcccttgcagtcgtcgccggtcagcgtctccaggccgtagctgccgaggccgatctgggtcaggtcgtcgtactcggtgtcaccggtgtcgtagggcacgttgagctgcgccagccggatcgagtcgagcacctgcaccggcgccgggtagcgcttggtggcgacgaagacgtggtcgagcaccaggccggccttgtcgttgatccgccagcacagctgccaggtggtgccgttcggcaaggtctccttgaccatcgacgacgcgccgcacggcgaggcggccggcgcggcctgcgccggcacggtcaggcccagcgcggccgaggtcatcagcgttacgacaccagcgaatttacggtacgccacggaagcttccccgctcacttgaggcgggcgacccggcgcccggacaggtcgacgatcacgtcggtgacattgatgaagtgaccatcggaggtcttgatgatcagctgtacgcaacggctcttgccgcactgcgtcgcgccccggtccgccggcttggacgtgtacacgtgcgcggtcggcaccaacccgtccgtaccgtgcaggtcctggccggtcgccttgcggtaggcggtcttgaagtccgcgccgagcgggtcggcgaccagcaggtccagtgcgaccttggcctcctgctcggacgccggcggctgcatcccggtcgccgcgtacgacttggtcagcttgccactcgccaggtcgacgacctgcttgtacagcttctgcgtgccgtagtcgtagtagtacagctcggcctgccggccggtcccgtcggtgtcgagctcggcagccaggtattcggggccggccttgccggtcacgtccttggccttcgcggccagctcgggggtgagcgcggcggcgcgggcccggtccacctcggcgctggtcagcgggtcgctgccggctccggtggcggcctcgggcagcgggctcgggtcggagacctgcgcctggccggcggcggcaccggtggtcggcggcgcggtcggcgctgcgctggccccccaggccgccaggccgaaggcgctggccgcgctcactgtcgcgatacccaggccccaggcccattttcgataacgatccactgtcggcaatccttcgcgtcgctcgggcagtgcgcgtgaaggatcaccaaaggtgagtgaaatccatgtgagtcgaacagaaatcgatcactgcgttggtgtcgttttctcgctgttcagcggggaagccggggcgtcgctgaggtgacaagaatttaatatttagttcatagttctccgagcatggtgtgaggttggcgtggttccggcccgtcgacaggcggtgcgatgatgatcgggctggtgtccacgacaggactggtgaccgttcatgaccatgcaggtcccgtatgccggcggccggctggaccgggcggccgcgcgccgcgcggacccgcgatggctcgccgaggtccactcccgcccggatgtgcgggtggttccgatctggcgggacgagtgcgtcgtacacggcacacccgcgcgggcgatcgtcgccgccggcccggcagcccggcggttgctcgacgccaccgccgagccggtgttcctcgggctcgacgacggcgccggcatcttcgccgtcgacctgtccgaatacgacagcggcaccgcggtggcactggccggcggtgacgcgaccgcgtcggtgcgctccgtctattccgagcacaccccggccgaggccgccaccctcggctacgcgcgcggcctgctgcgcgcgatccgcgaccagcggcactgcgggcgctgcggcggtcccaccgagccgcgccacggcggccacgtgcgggcctgcccggcctgcgaccggctgctcttcccccggatcgaacccgccgtgatcatgctggtcgagtcggccgccgaccccggccgctgtctgctggcccggcaccgcggctcggcgtccggcgagtattcgaccctggccggcttcgtcgagaccggggagagcctggaggacgcggtgcgccgcgaggtggccgaggaggtcggcctgacagtgggcacggtcgcctacgccggctcccagccgtggccgttcccggccgggctgatggtcgcgttccgggccaccgcgatcgacgaggtgcccacggtggacggcgacgagatcctcgacgcccgctggttcacccgcgccgagctcgccgggcgagccgcggccggtcgcctcggccgggtcgactcgatcgaccgcctcctgctgcactcctggcttgaccacaacggctgagggggcgacagggtcggacgggggcagggcattccttgccgctcggcgcgcagccggcgccgccgtcccgccgtcgccaccggcacccgggcccggtcagcccgccggaatctccaccagcttaccgtcccggacctgcagcagcaggaacaccgggttctcccgggtgccgtcggcgttgaacttgaccttcccggacagcagcggcagatccggggtggcggcgatggcggcacgcacggcggcgtggtcgaccgaaccggcccgcttgatcgcgtccacggccaccgtgaccgcgtcgtacgactccggtccgcccgcgccgggctgccgcccggtgaccttctcgaatcgtttcgaccactcggccagcgacggcatgagcgtcggcaccatcaacgcggtcccgaacacattcctggtctgcgcggcggtcagattcgtgagcagcggcccgtcggtcgcgccgtcgccgacgaagatccggccgtcgaacccggcggtccgcagatccctgatgagctggttggcctcgccgtaatagccggtgaagtacaccgtgtcgaccttctcgccgacgatctgcctggccagccgggcgtacgacggcgcaccctggctgagttcatgggtggcgaccgtctcgatacccgtaccgggcttggcggccgcatcggcggtcgtccggccgagggtgaccggaaagctggtgccgtcgttgacgatgatcagccgcttgctgcccatccggcgcatggcggcgaccgcgaagacgccctcggcggtgaccgtgccgctgatcaggaagacgctgtcgtacttcggcaccaacaggtcggtcgaggtggccagggcgatcaccatcggcacaccggcgtcccggaagaccttcagggtgggcacggtggcgctgctgcaatagccgccgaccgagacggtgatgtcctgcgccaccagatcgttggccttcaccacggcggtgcccgggtcgcaggcgtcgtccgagaccagcaactccaccttccggccgagcactcccccggccgcgttgacctcgtcgaccgccatctgcgccgcatcgcgcatctcccggcccgactgcgcgttggtaccggacaacggcaccagggcgcccaggcggatggcggccggcgccgaagcgccggaggtggccgcatggtcgccgccacaaccctcgagtgcggccgccccggccagcaccaggacagtgagcagagtgccgaaccgtgggcgaatgcccatgacagtgcctcccagcagaaccttgtcgccgccttctctcatcggcgtccccgcggggtgtgctgagcacttgcttcaggttcggcaacggtcggccgatggttcaacgaccaggccttaccggttaccgtccgaagggagacatcgtgaaacggtggcggatgccctccggacccgcgggacgccggtcgtccgtgcgcgacggctcccggggacggcgacgggtcagcctgaacaccacggccgcgctggcgagcgtgctgctggcgctcggcgcgtacaccatcatcggaaccgcgttgaccgcccaggcggtgcacgaccacagtcgcgccctccaggtggacgcggacttcagcgaggcccgcggggcgatcacgctcgaagaggtgaatctgcgccactaccaggtggagccgtcctcggcggtgctcagccgcttcctgcaggccgccgcctcggtggacgtggcactgcacctcgcggtccagcacgggctgcccgacgccgaccgcgaggcggcccggttgctggaccggcaacgggactaccggacgaacgccgagcagctcatcgccctggtggcggaccgcgatccggacagtttcagcgtggacagtctcagcgtcacgccgtcctactacaccctgcagcaggacgtggacgccgtcagccgggcgtaccatgccagcgcgcaacggcaggccgacgcgatgcaacgcgccgaggtgcgcatgctgatcggcacgtcggtcggcttcggggtggggctcacgctggtcggggtgatctggcggctggtgctcagctatcagcgtcgcctggtccaggatgccgacgccagcgagcaccggtctctgcacgacccgctgaccgggctgccgaaccggcggatgttccacgagcgcctgaccgactcggtccgggtgtcggccaaccggcgggatgaccaggtggccgtcatgatcatcgacttggacggcttcaaggccgtcaacgacacgctcggtcaccaggccggcgatcagcttctgcaggaggccgggcaccggctgcgggccggcatccgcgacggcgacctggccgcccggctgggcggcgacgagttcgcggtgctcctgtccggcgtcaccgatctggcgaccgccgtcgaggtcgccgagcggctctccgacaagatccggcacgacttcctgctcgacgtcggcgcggcctcggtcagtgccagcatcggtctcgccctcggcaccaccgatgtcgccgacgacgagctgctgcgccaggccgacgcggcgatgtaccgggcgaaggcggccggcgggggcgtcgcggtctacgacgcgctgctggacgccgtggcgcccgaggagatgagcctgttcggggagcttcgcgcgctgctggacagcggcgacccggagaatcagctggagttgttcttccagccgcagatccggatcgccgacggctcggtggccgccgtcgaagcgctggtgcgctggcgtcatccgacccgcggactgctgctgcccggggcgttcctcgacatggccgcctcccggggtctggagatcgcgctgacctaccacctgctgaaggtcgcggtggcgcaggcggaccggtgggcggcggccggcaacccgatggcggtgtcggtcaacatctcaccgcgatgcctgctgcacgacgatttcctgacccagatccgcgacgcggtcaccggtgtccacctgccgcacggcatcctgcaactggagctgaccgagagcagtgtgatgctcgaaccggaccgtgcccggaccgtcctgcgccaggtccgcgaggagggcatcctgatctcggtcgacgacttcgggaccggcttcagctcgctgtcccagctccgccagctcccggccgacgaactcaagatcgaccggtcgttcgtgcagggtctcgcccgggacgtcgacggcctggtgctggtccgcagcgccatcgacctgggccacaacctgggcctgtccgtcgtcgccgagggcgtcgaggacctcgagacgctggccgtgctccgcgagatgggctgcgatctcgcccagggcttcgcgctgagccggccggtcccggccgatgaggtgccggccgcgtgcgcccgggcaagccaggcggccggccagcagcgggtgccgcaaccacacgccgggtgaccgatatgccgaccgggtcacccgcaccctcacattcgcgatcaccctgatccagctctaccacgcagcactgccactgcgactacgacgccagcgaaacaaatcccgcgcccgcgactcgaaccagcatgtggcctccggccaggaccgccacgccgaccccgacgacagcgagcgagtctgtcgcaagccgactgcggccgttcggggcttctgcttgatcgatggagtgccgttggtgactacgctggcgccgatggaggcggagggtgaagcagcgctgggacggctgttggcgtatcggaggccgaagcttgccgcaacggcaggtactgtgcggccggaactgaaggaagtgctccaaggcggcgcgctcacggacgcgctggtgcggcgcctggcgccggcgctgggctggcgcaccgcggacctgttcgtgatcgctgggctcgatctaccccgcgatctggtccctgcaaacggcaccaagccttgggatgtcgggtcgatcctggagaaagcggcaaggctggcgccgcagtcgctccgccggctacacgagttcgtccgctcgcttcccgagcgtccgcccgcgtggccgccggctctgccgcgccatgcctacccgctcgggcccggcgagatgatgctgcgtctgctgcggaaccgtaatatccggccgtacagcccgaaggtgttgtacttcatcggcaacggtccgatcgtgtcgcactcgacgatggcgatgctgggaccaggccgtacgaagctgacgccgcagtacgtgacggctttcgccactgtgctgggtattcccgccgacgagctggcagccgtaacaggagtcgccgcggccgtggatccgatgcttcacggcaaccacgcggaactcgccgagttggcttgggctgcccggcgactggacggcaaccaacttgccgaggcactcgaactagcgacagagctgcgataacgacgctgtcgctcgacttactcgggtatccactcgtcgactacccgcgcattcacctttggctgacttcatgattgatggcacgcggcgtgagctggttcgcaggggactgtcggcaccaccggatggttgatagtgcgtacgtggttccgtggcggttcaccgctcgggccgccgagccacagctcggactggctggccggactcgaagcggtcacgaactgcgatatcgccatccgacccttccgggtcgacttcgacgacgttgtcttcggcctcatcgatgagaccactgacgatccatacgagggccacggagggccatgggccgagctcctccctcagggacttgggttccacgagccctggaacggccaatacgacacctgaggacgcggggatggctccgccccccgtgatcggtgcactcctcgcggcagaacagtatcgttgaccttggataggtgtttgcggcctgccgatcgcctccggcaagctgcggacgatgcgtaaagggggcgatgcagtggtcaagccaccgggcgaacaagtacatgtctggttcgcgttgactggctgcaacgcttcctccttcggcatgggcgctgaagtcatttcgcctgagcgcgtccggctcccgtctgctccttggtttccggtcgatgcggccaagggtgacattctccgcgtccagcagggagaggacggcgaactgtgggtgcaggagaaagttcagacagccggctactgtgccgtcaggttgatgctgacggccgacggcccacttggctccgtcgacaccggcacgaatgccatgctggacaagttcgccgcctttgccgtcacaggcaagggaatgtttggagttgcggtaatcgatattccactggaggcggatctcgaccggatacgcagcctgctcgagcatggccagcgcgccggctggtgggaatatgagaccctttgcgtaaccgatgcgtggaagactgcttccaccaagtagtcgtctggccacgtactcttctcggcaaggtgagcgcgccaccggaaaagccccgactgcaattgttgagccgccccggacgcgtcggtgcggccaccggaaaccggatggggatcctgcacgtcgtcgaccggtcgacgcggcggggactgtggcagtgcgaggtgatctcgttacgctgccggcgtgggtgacttcctcaagacgacgctggcccgggtgccggacggattcgacctgccggagccgctgcgcctgctcttcgcctgggtcgacgagcagggtttcgtggtgaaggggcacgacggtgacctgtacggctcgttgagcgacaacggccgggtgggtacctcgatcgagttgcgcggctacaccgacgagcagaccctgtcgtacgcacggtcctggttcgacgattccgtcccggacgcggccgcacggttgtggccgttcgcgcagaccggcggcgagggttcgatggccgcgctgtggcgcgacggcgagggacgggtcaggatcgtccatctcggttcgggcagcggttcgatcatgacgtgcgtgctcgccgacgacgcggtcgactttctccggctgctggcgatcggttaccgggagatctgctggaacgaggagttcggcgcgccgcctgagccgtgggacgccgaccacgaggtcgtcaatgcgccctaccgcgactggctgaaccgcaccttcggtgtcaccgccccggcgaccgggctggagatcgtgtcggagcccgccgagatgggcgacgaggacaccacggacccgttctgccgctgggtcgacaacagggacgcctgaggtggtcgcgggtgcaggacgccttggcgatcaacgccgttccgcggggtcgccgacgctggtggtgatccgcggcaattccgggtcgggcaagtcgacgaccgcccgcgaggtgcgccgccgctacggtcgcggggcggccctgatcgagcaggatcacgtgcgccggatcgtgttgcgagagcatggggacgtcgacgaaccggtcgcgccgcggctgatcacggtgatggcccggtccgcgctggacgccgggtatcacgtgatcctggagggcatcctgtccgccggctcgtacggccctctgctgcgcgccctcgtcacggagcacccggggccggcggcgaccttctggatgcaggtcggtttcgacgagaccgtccgccggcacgagcgccgcgatccgccgatcccggtcaccgccgcgatgatgcgtgcgtggtacaccgaccgggacctgctcggtgtgcccggcgagcaggtgatcgacgagacggtcggcttcgaggaggcggtcaccacgattttgcacaccagcggtctggccacgaccgcggcgctgacgccctgcccgatccgctgcccgcggtgcgcaccggtgcacgaatcgtcctcgcgccgcgtccaggagtggtgaccgaccacgacttccacgttcccgggccgacgctggagctcattcacgcccgggtgcgggcgctggccgtgctgcgccgccgccgtcgtcgccgcacggtcgtcgcggccgtcctggtcgccggtgcggtcctggtcagcggaacaatcggcgttcgtaaccggcgatgatcctcgggtaggcgcgcggcagcagccgcaccagccgatcgacgagtttcgcgtcgccgcccaccaggatccgcgatttcccggccgccacgccgtcggcgatgatccgtgcggcctgctccgcaggcagttcaggagcttttcgttgtacgtccgtgcccgcgcccgttggtcggcgctgggcgacagccccgcctcctcggcgtgccgcaggctggccgaggcgatgtcggtcttcaccccgcccgggtgcaccacggtgacccgcaccggatggccggcgtgcagcatctcggtccgcagcacctcggtgaagccgcgcaccgcgaacttgctggcgcagtacggtccgagggtcggctgggccatgaacccgttcaggctggacacgttgatcacatgcccgtccccggaggcgatcaggtgcggcaggaacgccttcgtcccgtggatcaccccgtacaggttgatgctcagcgtccggtcgaagctcgcccagtcgctgtccaggatggtctgcccgccgccgctgactccggcgttgttgtagatctggtggacgacgccgtggtgcgcggccaccgccgccgcgtacgcctcgaccgcgtcgcggtcggcgacgtccaggtacgcggtgtgcaccggcgcgttcacccgctcggcggtctccttcagcccggcgtcgttgacgtcgctgagcgcgagccgggcgccgcggcggccgagttcgagcgcgagggcgcgcccgatgcccgacccggccccggtgatgacgacgaccttgtcgtgaaaactcatgagaaatgcagctccgggtcggtgacgtcgtccccccgcaggagtttgacgtcggactggtagtccatcgaggtcagccacggcatccggtcaccctgccggggcagttggtcgacggcccgctggatgtagccggcgccgaagtccaggaacggcctggtcggcatcgccgggtcggccacgagcggacggcacacgcggtatccgccggcctccatgtgtttcaggacgcggcagaagtgctcgcacaacagaccgatcttgagggtccacgacgagttcgtgtagccgatggcgtacgcgaaattcggcaccccggaaagcatcatccccttgtacgccacggtctccggcagggcgaccggcaccccgtcgaccgacaccggcactcccccgaacgcctgcacgttcagcccggtcgccgtcacgatgatgtccgcgtccagatgctgcccggaggcgagttcgacaccgcctggggtgaaccggacgatccggtcggtcaccaccgccgccttcccgccccggatcgccgtgaacaggtcgccgtcgggcactgcgcacaaccgctggtcccacgggtcgtacggcggattgaaatgctcgtcgacgggatatcccggcggcagctgacgggcgttgacccagcggatgagtttgcgggccgctttcggataccgctggcagaacgaccagacggccttctgctgggcgatgttcttgcgccgggtccaggcatatccgcgttccggcccgagatacttcttgagcgcgttcgcgaccgggtccttcttcgacacgggcatgatgtacgacggggtgcgctgcagcatcgtgacccgcgccgctccgccgtcgaccagggccgggacgagggtgaccgcggtcgcgccgctgccgatcacgaccacccgccggccggcgtagtcgaggtcctcgggccagtgctgcgggtgcacgagcgtaccgccgaaccgtccctcgaaggacggcgtgaaaccctcgtcgtaccggtagtaaccgctcgccgagaagatccagtcgcaggtgatctccaggctggtcccgtcgacgtcgaccgagaccgtccagcgcgcgtcgtcggtcgaccaggccgcgccgacgacccggtggtgatagcggatgtgtttctcgatgccgttctccgcgatcgtctcgcgcaggtagtcgagaatccgcggcgcgtcggcgatcgactgctcgtcgcgccacggcttgaactcgtatccgaacgtgtgcaggtcggaatcggagcggatgcccggatagcggaacagatcccaggtgccgccggacgcgccccgggcctccaggatcgcgtagctcttgcccggcaactcggtcgtcagatagcgcgcggcgccgatgccggagatgccggcgccgacgatcaggacgtcgatgtgctccacgcagtaaagaatccgtgccccgagccggttgcgccagcacaaaacgcaccagcatgatgactttcatggtgcagagtgctgcggagtggccggtcgtgtcgccgcgggtcgccgagctgttccggcagggcgcgcaggcggcgctggacgcggaggccgagtcggtggaggcggtgcacgaggcgtcgctcagcggcgaccggatgcggccggtcgccgacgacccggtgctggtcgccgcggtgcgccgcagcaacgtggcgaacctgcggcagtggaccgaggcgaatgtgcgcgccccgggccgccgggtgccggccaacctgggcccggaggttctggaaacggcgcgcgacatggtccggcgcggcctcgaccagcgggccctcgactcgtaccggaccgggcagagcgtcgcgtggcggcgctggatgcggatctgtttcgcgctcgacgccgagccggacgagctgcgcgcgctgctcgacgtgtcgtcgctgtcgatctccacgttcatcgaggacacgatcaccgcggtgtccgcccggatggaggccgagcacaccgagctgacccggggcgcacacgccgaacgccgggccgcggtcagtctgctgctggagggcgcgccgatcagccggggacgggccgaggcccagctcggctaccgcctgaccggcccgcacaccgcggcgatcgtgtggaccaccgcggacaccgccaccgcgcgcctggaggccgccgcggaggcgctgacccgggccggcggcgccacccatcggctgaccgtgctggccggcgcggccgcgctgtggctgtggctgccggtcgcggtggcaccccggatgaccgattccggcgacccggacgtccgggtcgcgatcggccgccccggcgccgacgtcgagggtttccgccgcagccacctggacgccctggccacccagcggatgctgacccggctgacgtcgccgcagcgggtcgcgcactacgccgacatccagctggccgcgctgctgaccatcgatccggcccagtgtgcggagttcctcgccgacaccctgggcggcctgctgcacgccgacgccgagacccgggagacggtcgccacgtacgtccgcgagcagtgcaacacgctgcgcaccgcggaccggttgttcacccaccgcaacacggtcgtccgccggttggcccgcgccgacgcgctgctgccccgcccgctcgccgacaacgtgctggcggtcgccgccgccctcgagatcctccgctggcggggctgacgaaactttttctggcagggtgtcgatcggggcggtcgccgttcgacgcacaggtgaagagccacccgcgacactggaggagacaacgcgatgcggttcatggtgatcaccaaggcgaccacggccagcgaggccggtgtcctgccgaagaccgaggacttcgcgacgatgggcgcgttcatcgaggagctcgtcgacgccggcgtcctgctggccgccgagggcatcggccccagctccaccggcgcccggatctacttcgacggcgagaagaagaccgtcgtcgacggcccgttcgccgagacgaaggagctgatcgccggcttctggctggtcgagatgaagtccctcgaagagtgcgtggagtggttcaagcgctgcccgatccagaagaccgccggcgaacccaccaacatcgagatccgccgtctgtacacggcggcggacttcggcgacgaactcaccaccgagcagcgcgaggccgtcgcccgccgcgaggagaaggccgacccgtcctaccgctcggcatagccgcgacggatcgcgccacggcctgagcctccccggtcgacgggccgggatggccgcggcggatcgcgcggtgggatagtcggggcgtgccgaccgacacccaccgcgcgatcgagacggtctggcggatcgaggcgccgcggctgatcgccgggctcacccggctggtccgggacctgggcacggccgaggagctggctcaggacgccctggtcgcggccctggagcagtggcccgtccagggcgtcccggacaatccgggcgcctggctgacgaccgtcgcccaccgccgcgcgatcgaccggatccgccgcgccgagacgtaccggcgcagggtcgaggaggccggccgcgaccgaaaggactcggcaccggatgtcggcacgctggtcgccgaggacgacggcatcggcgacgacctgctccggctggtcttcatcgcctgccacccgatcctgtccaccgaggctcgcaccgcactcaccctgcgcctgctcggcgggctgaccaccgacgagatcgcccgcgcgttcctggtgcccgagccgaccgtcgcccagcgcatcgtccgcgccaagcgggccctggccaaagcccgggtcccgttcgaggtgccgcagggtgccgagctcgccgcccggctgtcctcggtgctcgaagtcatctatctgatcttcaatgaggggtacgccgcgaccgccggcgacgactggatgcgccccgccctgtgcgaggaggctctgcggctgggccgcgtcctggcccggctcgccccgcgcgaacccgaggtccacggcctggtcgccctgatggagatccaggcgtcccgcgccgccgcccgcaccaccccggacggcgaaccgatcctgctggccgaccagaaccgcgcccgctgggaccgcctgctgatcagccggggcctgtccgccctgcgccgagccgacgagctgcacgccggccggccgggcccgcgagagtcgcggaccggcaagcccggcccctaccagctgcaggcggcgatcgcggcctgccacgcccgggcccgccggttcgccgacaccgactgggtcgccatcgccggtctctacgagcggctggccgaggcggccccgtccccggtcgtcgaactcaaccgggcggtggccctgtcgatggcctacggcccggcggccggtctcgacctgctcgaccagctggccgccttcccggttctggacggctatcaccttctcccgggtgtccgcggcgacctgctggcccgcctcggccgccacaccgaggcccgggccgagttcgcccgcgccgcgtcgctgacccgcaacgaacgcgaacgcacggtgctgctgaaccgggccgccgcctgcgaacggctcggctaatccgggcggccgaagaacaccgcgcagtccacggcccgccgccaccgtcggtgctcggccgcccgccgcccggcatccatcgcgggcgtccaccgccccgcatgatgccggttggcccgcagatcccgcgggtccgaccagtatccgaccgccagcccggccgcgtacgccgcgccgagcgacaccgtctcggccaccatcggccgcaccaccggcacgtcgaggaagtcggccacgatctgcatcagcaggttgtccgcggtcatcccgccgtccacattgagtgcggtcagcgcgagccccgcatcggcgttcatcgcgtcgaccacgtcccgggtctgccacccggtcgcctccagcaccgcccgggccagatgcgccttggtgatgtaggaggtcagccccacgatcaccccgcgggcccggctgtcccagtgcggcgcgaacagcccggagaacgccggcacgatgtaacacccaccgttgtcccgcaccgtcccggccagcgtctcgatctccgacgcggtgccgatcagcccgagcccgtcccgcatccactgcaccagcgatccggtgatcgcgatcgacccctccagcgcgaacatcggcgcctggtccccgatccggtaccctagctagctagcgatcccgatcgcggccacctccgtgaccccggcctcgcgcagcacccgcccgatcagtcgccgcacgtcccgccagatccgcgccgcgtcgtgctccacccagcccggctgcggataggactgcggatgctcggcccgcgccacccccaccacggtcgcccgccggtcgaacaggatgcaccgcgtcgacgtcgtcccctgatcgatggccagcacgaagctcacgcccacacccccgacgagaccgtccggcccggtccgaagctcacgcctgcacctcccgcgagatcgagcgcgccaccgccaccacctgctccaccagcgccggccgggcctgccgccgggtgtcggtcagccgctcgaccggcccggccaccccgaccgcgccgatcaccagcccgccggacgcccgcaccggcgccgcgatcccggccagtccgggccgccactcctccaccgacagaccccagccgccggcccgggtcgcggccagtgcccgggcgagggcgccgctgtcggtcaccgtccgtcgcgtgtacgcggtgagccctcccgccaccgccgcccgggtggccgccgccgagtaggcgagcagcaccttgccgagcgcggtcgcgtgcggcgccagccgggtcccgatgtcgaggctctgcgccgagtcgtcgggccggaacacgtggtgcacgaccagcacctgcccgtcggcgagcaccccgagccgcacctgttccccgctgcgggcggccagggtgtcggcccagttcagtgcccggccgcgcagctcgttcgcgtcgatgccgggcgcgcccaggtcgtgcaggccccgaccgagccggtagcgggcggtccgcgggtcctgctcgacgaaaccgacgtgctccagggtgcgcaggatgctgtgcgcggtcgatttcgccatcccgagggcgtcggcgatctctttcacccgcagccggtcgtcaccggccgcgagcagccgcaacacggccgaggaccgtgcgatcgactggatcaggccgggcacgtgcgacattgtcgcacgcatggcgttgccgcgtccccgggtcgctcttagcgtcgctgccggggttcgggcatccagggagggccagtggggcggtacgtcggcgcgatcgatcagggcacgaccagcacgcggttcatggtcttcgaccggtccggcgcggagatcggccggtgccagctggagcaccggcagatccagccgcggtccggctgggtcgagcacgatccggtggagatctgggagaacaccctcaaggtgatcgcgggcgcgctggccggcaccggtctcaccccggccgacctggccgcgatcgggatcactagctagctagcctaccgtttcgccggtcaggcgccggtcttcgccctggaggggtcgatcgccgcgtgcggcgccgccatccagtggctgcgcgaccagctcggcgtcctggacaccgcggccgacagcgaaaccctggccgggcaggtcgaggacagcgccggcgtctgcttcgtgccggcgttctccggcctgttcgccccctactggcggccggacgcccgggccgcgatcgtcgggctgtcccgtttccacaccgccgcgcacctgacccgggccgcgctggaggcgatctgccaccagacccgcgacgtggtcgaggcgatggcgcaggactccggcacggccctggactgcctgcaggtcgacggcggtgtcaccgcgaacgcgctgtgcatgcagctgcaggcggacatcctcggcgtcccggtcagccggccggccgtggccgagaccaccgcgctgggcgccgcctacgccgcgggactcgccgtcggcttctggtcctccccggccgagctgcgcgccaaccggcacgaggaccgccgctgggaacccacctggccggcggaccggcgtaccgaaggcatcacccgctggcgggcggcgatcgaccgcaccctcgactgggtcagcgtcggctgaccggccctgtaggaaagaaggatcgactatgaaaaccggagtgatctcgccggagtcccggcggcgggccctggccgccatgacgtccggggagctggacgtgctggtcgtcggcgccggcgtggtcggcgccgggtcggctctcgacgccgccacccgagggctcagcgtcggccttctcgaggcccgtgacttcgccagcggcacctccagccggtccagcaagctgatccacggcgggctgcgctacctggagatgctcgatttcagcctggtccgggaggcgctgcgggaacgcggcctgctgatccagaagctcgccccgcacctggtccgcccggtgccgttcctgtatccgctgcagcgccgggcctgggagcggttgtacgtcggcgccggcgtcgccctctacgacatcctggccctgtccggtggcggcgccggcgtgcccgtgcaccggcacctgagccgcctggaggcgctcaaggcgttcccgtcgctgcgcccggagaccctggtcggcgcgatccgctattacgacgcccaggtcgacgacgcccggcacaccatgttcctggtccgcaccgccgtggccaacggcgcgcacgccgcgtcgcgcaccgaggtcaccggtttcctccgggagggccgccgggtcgtcggcgtccgcgcccgtgacctggagaccggcgccgagctggagatccgcgcccgcaccgtgatcaacgcgaccggcgtgtggaccggcgacagccaggccctgctgaccggcgaacgcggccagttcaccatcgccgcgagcaagggcatccacctggtcgtcccgcgggaccggatcgccggccacaccggcatcatcctgcggaccgccaccagcgtcctgttcgtcatcccgtgggaccagcactggatcatcggcacgaccgacacggcgtggaatctcgacaagtcggacccggccgcctccggccgggacgtcgactacctcctcgacgaggtcaacagggcgctggccgtcccgctgacccgcgacgacgtgcagggtgtctacgccgggctgcggccgctgctgtccgccgaggcgtccaccaccgccaagctgtcccgcgagcacgcggtcggccacccggtccccggcatggtcgtcgtggccggcggcaaatacaccacgtaccgggtgatggccaaggacgcggtcgacgccgccgtccaggatctggccgcccgggtcccggcgtcctgcaccgaccaggtcccgctgctcggcgccgacggttatcgcgccgcctggaaccgccgccagactctggcccgcgaatccggcctcaccgtagcccggatcgaagccctgctccaccggtacggcaccctgctcgacgaggtgctcgccctgatcgaagccgaccccagcctggccctgcccctggacggtgcccccggccacctgcgcgccgagatcgtctacgccgccacccacgagggcgcccgccacctggaggacgtgctggcccgccgcacccgcatcgccttcgaaaccccggaccgcggggtgatcgccgcccgcgccgccaccaccctgctcgccccggccctgggctggtccccggccgacgccgagcgcgaggtcgccacctacgaggcccacgtgcgagccgaactcgccgcccagaccgaacccgacgaccgctccgccgacgccaccctccgagccctcaccaccagccccctgacctcggccgtctgacccgcgcgccggtcacctcggccgcctgacccgctcggccccgggccgagcacgcacaacgcgctggagcactccggtcccgggcactgcgcccgggaccgctacggcgtggccgcctcggcaccgcgcggccgaggcgggttggcgaccgctcgtaatatcgacaaacgtgatggacgatgagccggaggccgtggaacccaccccgattcccccgtcccggtcggggagcgcgggcgcggtactcgccatcgtcgtcctgaccgccttcgccggttatgcgctggtgctggcttacctcttcagctgggccgccgggaaccgttgcgtccccgacgatccgggcttcttctgcaccccgaccggcgaatcgctggcctcgatcgttccgatgatcgccaccctggccggcgcgatctgcggctacaccggcatgagccgcccgccggggcaccgcggtcggctgatcctcgtcggctatctgatcatcgcgggtggactgctcgtcgggcgggtgctggtcgacgtcggctgatctccggcgatcagtgcggtgctgacagccctcgttgcgacggcttgtcggtatgcgcccccgggtccggcaggacgagtttcccttgtggaacagcttcacgtcgcatagtgttgtcacgacaacatgggggttgcgatgtacgagttcggcgagagcaccgtcatccgggccgacctgtccgcggtgtgggacacggtcaccgacgtcagcgcctggcccgcgtgggatccgcacgagcagcaggcccgcctcgacggcccgttcgcgacgggcaccaccggctggtccaagccgcgcggcggcccggccaccacctggcgtctcaccgaggtggtcccccgccgccgctgggccagcgagtgcgacctgcccggcgggacactgtccggggtcaccgcctacgagccgctcgacgaccggcggatccgctgcaccaagaccatccgggtcaccggcccactgaccccgctgttccggttctacttcgcccgccgcatccgccgcgacatgctgaaaacctgggccgccctggagacccgaagcgcatgaccggacccgacgcgcagagcaggcccggccccggccccgaccccggcacggaaagcatgaccaggcccgactccggcccgatgctctcccccggcttctggctgcaccacgccgccctgacctggcgcgccgagttggacgcccgcctgcgcccgctcggcctcaccccgacccagttcatgctgctggcctcggccggctggctggagcacgtctccggcccaccgacccagcagcaggtcgccgacgaggccggcgccgaccgcatgatgacctcccgggtggtccgcaccctgcaggagcgtggcctgctgacccgcagccccgacccggccagcccgccgtcgctgcgcctgagcctcaccgacgccggccgcgccgtcacgcggcaggccacccgggccgcccgcgacgtcgacaccctgatcttcggcgacgccgccccgcacctgcgtaccagcctgcggcagatcgccgagtccggaggaccgacaagggtggcccgaccgcaccggccgggccacccttgacgaagcggtatcagaacgggctgaccgtgaacgtcgagccgctggtcacgtccgtctggaaataggccgggtcggtggtcgccgcatccggcgccccgttgctgaccaccaccaggttgtacgcgccgtccggcaccggggccgcggcgtacaggttggcgttgaccggcttgttcagcgtgaggtcggccggtccggcggtgacggccgcctgcgccgacagggtcgcgctggtgcccgcgaccaccgctccgaccgtcgtcccgggcgtgatgcccagtgagttgttgccgatcaccgcgccgctgtcgctggactgcagcccgctgctggtgagtgtcgtcgacccgccggtcgtgctggccgcggacagcgtgtactgagtgctggccgtggccggcgcggacagggtggcggtggcgcctccgggggcgaccgcggtgatcgtggtgccgttcgcgataccgctggtgccgctgacgacccggccgatgtcggcacgggtgaacgcgccgctggaggtggagaccgtcgcgctgcccgcggtcgtggtgatcgatccggtgaaggtgtgtgccggcaccgcgccaccgatggtggccgacagggtggagccggtcagcggggacggggcggagatgaccaccttggtcgggccgagcaccgaggtgatcaggctgttcggcgggatgttggcgttgccaccctgcacgatcggctggccgaggtcgttcgggctgaacttgccggcggccgagaccaccacccggctgcccgccgtggtggacaggtcggaggcgatcgtgttggtgtaggcggacgggtcgaagaagccggtgccctgggcgttcagtttgcggttcagctgcagcgtgcagaccagttcggtgtcgctgatcggcagcacgttgacgcattcggcgaccgggccgttggcccgcaccccgctggtcacctcggcgccgttgtagacgccgttgaccaggaacacccggccggcgttgccaccggtgccgaagttgatcgccacgaagccggcgccctggacgtcgacgtcgaccgtcggtgacgtgctcggcgcggtgttggggctgaccgtgatggtgttcaggtaggagtacgcgccgggcagcgccttggtgccggccggcgtgctgaccaccagggtgaggttcgtgtcggcggtgtgcgcgggcacctgggcggtgaacgccttgtcgctgatcggctggatgttggtcagcggcacgccgtcgagggtcgcggtgatccgtccggcgtcggtcgggaagtcggtgccgaccacggtgatcgtgttgccaccggcgggcgggccggcggacgggttgatgcccatcgggttggccaccaccccggcggtgtagttggtggtcccgatcaggccgctggttccggtgctgccgctgtagaagcagatctggtacgtcgtgggctgacccggctgctgcagcgtcaacggtggcagggtgaccgcggcccggctgctggtcagtctgcgcacgctgcccggcgcggtcagggcgagcggggtcaccccgttgacctgcccggtggagtaggtgccggggcagccggcgttcatcggcaacaccagcacggcgggggtggtgattccggtgaggaaggcgccgggagcgctgacggtgacgccggtgctggccgagtacgaaccgctgcccggggtgacggccagcgcgttcgcgttgtagccggcgatgctgagcagggagccggcggcgctgctgccgtcgtacaggcagatgttgtagttggtgggtgccggcccgttggtgaccaccccggacgggacggtcagcgccaccgtgctgttcgactgccgggccaggccggcgacggtgaggttcgccgggttggtgctgcccagggtggcggcgcactgtccggtggtgaagaccgcggacacggtgttgtaaccggtgaagaccgggttctgcatgccggtgctgagggtgagcgggttgccgccgccggtgagaccggcgttgctgctcgcggcggccccggcgccgacgtacagcgggccgccgctgagcaggttgctggtgccggccgtcgccccgtcgtaggcgcaggcgtagtacagcttgacggccccgttggggccgggggccggcccgccgctggccggcacggtgaaggtcagcgaggtaccggtgcggttgctgacggtgggattccacggtccggtgccgccggcggtagccagtttgcccgggcacgggctggtgttcagctgcacgaccgagttgccggtgaacgccgcgctctggtcgctgagcgtggcgttgccacccggcatgacgatccacgggccgatgttcgcgccggccagtgccggcaggggcgccgccaggatgacggcgcccaccgcgccggcggtgagtccggcgccgagcaggcggcgccgggttcgggacaggaattgggacatgcgtcgccctccaacggcggtcacaccgcagatcaggatcggggttcgagggcggccgcggtcgcccgtgggcagcctaatagcgcatgtcggaaactatttggcttatcggattcatccgttttaatccgacatttaaccgctctagctagctagttcaggaccgggggacgccccggcgccgtccggagaccgcccggcggccgcgggagaggccgacttcgagtcggcagcgggccggcatcccgccatcggcagcagaagcagcgctgcggcgacggcgatcgagcgcctgcccagacgattcgtataggacatggtaatcccctagtgggtgtggagcggaaagaccgccggtgacattaatggcgtcgccgaacactttccacaggcccccaggccgcccgtgacccgcattttcagaaaagcgcgagccgattactccgagtccgatgtcactttcccggaaactcgatgccgactcacagcgacgcggaaccgagcgcgacggcaggttgacgccgggtggcggcggcgcgctggtgaggggtgtcgccgagctgcggtgacacttattgcggaacaccttctgcggcgattgtcacaccggtgtatccggagctcgaagcagttctcacggaaccgttattcctcaggtatcgtctcgcgcactgcacacgggaagtcgaggtcggcgcggtgggaaaaagcgggaacacgggattggtccgtcgtgcgcagcagggggaccgccgggccttcgacgcgctgatgcgacacgagatcccggtcgtctactccgcggcggcccgggtgctggcgcccgccgacgccgacgacgccgttcaggagacgttgatcagtgccttccgcaacctgaaagacctccgggaaccggacaaactgcggccgtggctgctgacgatcgtcatgcgagaggcgcggcggcaggcccgggacgcagagctgccggtgggtctgccggccggttctgccgagtcggtgccggtcgacgtccaggaacgtgcggtcgccgaggtgacgctcgccgaacaacgtaaggacatctccgcggcgaccccgtggctcgacccggaggaccgggagatgctggcgctctggtggctggaactgctcggtgaagtcgaccgctcagggctggtgcaagcggcggggaccagcccgaaccacgtggccgtccggctcaagcgcctccgggaacgcctgactgcggtgcgggtgctcgtccgcgccctcgccgcccgggaccggccggacgggtgcgccgagttccgggtgctgctggccggttggccgggccggccgtcctcggtgtggcgaaagcgcttcgtgaaccacatctcgcagtgccccacgtgcggcgctctgcggcatggcctggtaccgcccgaactcctgctgtccaccaccgcgttgctggtggctcccgccacgctggcggctcaaccggccaccgcgggagcgatcgtccgggtcatggacgccggcaggcggttgctgcacgccggcaaggccgggatcgctcaaccggtcgccgcggtagccgcgaccgccgccgtgctgggcggcgccgccgtggtcatcgcccgcacgggtgagtcccgcccgctgccatccgcgcaggcgccgagcaccacctccccgcgggccccggttctagctagctaggacgaggcgaacagggggtaccgacggtggcggcggagtcggctacccctccacgccggtggcggtgtgcgcggcgccgaccggcttcgactgcgacgagccacgctgccgcagatagatcgccaggatcgccatcgacgccaccgccagcagctccgactgccagttctgcagcgtgcggttccagaagtcgggctcggtcagatactgcgaccaggacaccgggtcctgcaggtcgccgagctgccgctcgttgaacgcggcccggccggcgatcgactggcccagccaggacagcaggaagatcagacccatcaccaggctcaacgagttggagaacagccacagccggactccggtggcgcgggcccatgccggggagtccttgtcggcgtacaccccaattttttgatctttgtcggtctcgcggcccggcttgtcgagctctttggactccggggagcccttctgcagcagccagacggtcagcacgatgtagaggaagaactgcaggtattccgactgccagttctccaggacgtcggcgccgaagctggccgaggtgaggtagcggccgaacgtgatcggcggcaggccttcgacgagctgctgctggttgaagtcggcgtgcccggcgatcgcctcgccggccagtacgatcaggaacagcagcccgaagaccaggccgagcgagttctcgcggaggaagcgtttcatcggtgcagcacccccagcgcggtgaaatagatcaggccggcggcgaccaccagcagaagcagcacgaacaggaaccgcatcgctcaactcccctgcagggtgcagtcgtagggctggtcaccacgcggcttgcagccggccgcgaggacccgccagccgcccgggaacacgccgaggaagatggtgtcgtcggcgaggcgtacctgggcctgctgaccgaaaacggccgcgctgatcacgcggcccggtgcgggcaggtgctcgtcgaggatcgcctcagggcacgatgtgccggccgatttctccagctcggcgcgggtgcgcggggccaggctcgcgcaggcggcggcgccgtcccggccggcgaccgccgtcagcctagctagctagcggcgtcctcgcgaccgccggccgcaccgcagccggccagcagaagcacacccgcagtcatgatcaacacgcgcttcatggcgcgcagcattcccaggacgggcggattccaatcccggtacgccggtgccggggctaccgtgaccgcgatggaccatgatggcgggacacgggtggcgcgggtgaccggcgccgggagtccgaacgggatcggtgtcgcgatcgcccgggagctggcgtcggccggcatgcgcgtggtggtcacggccaccaccggccgggtgcacgaccgcgcggccgagctcggcggcggcgccgtcgggctggtcgccgacctgcgcgaccgcgcgcaggcgcagcggctggtcgacgccgcccgggccgcgaccggcgagatcgacgtgctggtgaacaacgccggcatggcgcagaccgggtacgcggaccggtccgccgaggtgggcgacctggacccggcggagttcgaccggcagctcgcggtcaccctgaccacctgcttcaacgtgacccggctggtgctgcccgggatgatcggacgcggccacggccgggtcgtgaacatctcgtcggtcaccgggccgctggtcagcgtgccgggccagtcggcgtacgcggcggccaaggccgggatggacggtctgacccggacctgggccctggagggcggccggtccggggtgacggtgaacagtgtcgcgccggggtggatcgcgacggcgtcgagcaccccggaggagctgcgggccggcgcggcgaccccggtggggcggccgggccggccggcggaagtggccgcggcggtcgccttcctggcctcaccgaaggccgcctacatcaccggccaggtgatcgtcgtcgacggcggcaacctgctcgacgaacgccgcgcctgaccggcggcggcgcgcccgccgaccggtctgcgcgcggaccacggtgctggcggtgcccaggcaggccttcagcatgccctacaccgcctggcccgacggtgcccgtctgctccacagcctgacccggtcgccggcatcgtcgtcctgactccgcgcccggtgtcaccacaccggcaccggagtacggtggcccgccaccgcgcccgggagggacggggttgaagatcgttgatagaactggagcggtaaggtgaactactgtccacattgttctcaaaacgggggattcattgcgtacacgcctgcgcaccattctggctaccgccaccgcactcctgctggcgccggccgtcgcgccgcagccggcccaggccgcgaccacggtccggctgaccgccatgcagtggaacgtcgacggcggctggaaataccagacgcccggcgcgtccgacctgctggtcgccaagatcttcgacacgatcaaggagaagaacccggacttcgtcgccctcaacgagatctgccagagtcagtacgccgccctcaccaagcggctgcagaacgagaccgactggccgcaggacaaggggaacttcgtccggttccaggcgacccgcaacggcacgaccgacgacggggacgtctgcgaccacaaggcggtcggcatcgcgctgctcagccggcagccgctcggcacggcgaaccggttcgcgctgaccccgaacccggatttcgacaaggacgagatccgccacctgctctgcgcaccgaccaccacgatgccggtccgctactgcgtcacccacatcaccccgaagccgttcggcacgatcgggaagatccaggtcaacgaggtgctctcgcacgtcgaggacttcgaggcggccggtgacacggtgctggtgggcggcgacttcaacgccacgccgagctggccggagctcaacgtctggtacgaccggagcgtcaacaccccggcgaacggtgacaacgtcggcgcgtaccgggagatggacgacgccgatccgtactgcctgggctacggcgaaggcaccaccggggcgaccaccggcagcccgtgcggcaccggcacgaagatcgacatgatcttcttccgggccaaccacctcaacggccagcacgccggtgacgcgctgccgatgagcacctgcggcagcgcgccctgctccgaccaccgcctcttctggggctgggccgacctgagcatcggctgacccatggtcgtgggcgggccggtccggctcgcccacgaccgtctccggtcagctaccggcggtccggcgcggacccgggtccggctgagcgcgatcagtgccgcgccggcacggtgaaccagcgccggtcccaggacgcggacaccacggtggcggtcaggacgaacaggccggccgcggtcagcagatggatctcctgccgcccgggaacgcgcagcccgaaaccgatcagggccgccacgcttgccggcacccccgcgacgcccagcccgagcagccaccggcgggtcaccgccggacgcccgctcagtggcagccggtcgtggacctcgcgcagggccaccgccgtcgcgaccccgatgacgagcagccccgcggccgcggcgaacaggcgtgagccgaagccgagctcgtaccggatcgccatggccggaatcaggaacagcgccagccaccaggacagcccggtgatcagcgtgtcgagaccgggcccggtgaccgtgaccggccggcggcgcagccgggccgccgcgaaccgggcggccgcgatcacgacgacgtcggcgatcatgccgggcaggtgcgccggcagtctgcccaggctgtagagcagcacactgtcgtacagaccgaggatgaggtggccgagcgcggcggtcgacgccgcgaacaccaggaactcgtgggcggtccggggcgccccggtgcccggcggcgcggacggccggcgccccagacggatcagcgccaccgcggtcagcaccccggagacgaaccgcagaacaagatcttcgatggtgtacgtcgtatgcatcgcccactcgatcagcccgaacgtgatcgagtacgaggcactggtcaacgccaccacggcgggcgtggtgagccgccggtacaggcccgggtcgagccagtcggcgatggtcaggtaggcgagcatccccagcggcagctccagcagcgacggcagccgcagcgccgacaacgccaggagctgcggctgcggcgtgtgggcgaccagccaggagacgaccgggccgtcggcgagctggaaccacccctgcggcacgtagccgccgaggtagcccaggtcgccgccgtggacccgccgggcgtagatggtgaacgcgatctggttgagccacagcagtccgatgacgatcaggagccaggtgccgggccggtgccgtcgacgtaccgcgccgtgatgttcttccgcggccttcgcccgtcctgtcaccggcaggccgatcagcaccgacatccccaccgtggcgtgcaacgccagacccgtccccgtcatgatcatcgaagatagacgacgggggcgagccggcgtccggtcagttaccgcggcactggtaggtcgggttcgatccgtggaactgggcgtcgccgaaggcgaagatcccaccgtcgcagccgttgagccagtatccgccggcggacggggtgaccgacatgccggtgatgtgcccgttgagcggctggccggccatcgagccgaagaagcccgcgtcgccgaaggcgaacaccccgccgtcctcggcggtcatccagtacccaccgccgtccggggtcacgtccatgtcgacgaccggcgcgttcagcggcttgccgcccatcgagccgtagaaggcggcatcgccgaacgcgaacacgccgccgtcgccggccgccagccagtagccctggccgctggccgtggcgccgatcgcggtgaccggcttgttcagcggcttgccgcccatcgagccgtagaagccggcgtcgccgaaggcgaacaccccgccgtccgcggcggccagccagtagcccttgccggacggggtgacggccatcccgacgaccgggccgttgagcggcttgccgcccatcgaaccgtagaacggggcgttgccgaacgcgaacacgccgccgtccgagccgaccagccagtagccgccgtcgtccggggtgcgggtcatcccgatgatgttgttcaccttgacgccgagcccgggcagggagccgtggaacggggcgtcgccgtaggagaagacaccaccgtacgtgtccacctgccagtagccgttgccggtcgacgtggcggtcacgtcggcggcggtgggcagcatcgcgacggtgaacgaggtcgtcgcggtcgcggtgagcccggacgggtcgcggacggtgaccgcgacctggtaccgggcgcccgggtcgaggcggtgcgcgggcacggtccaggtggcgccgaccgggccggacgagacgtcgaccgcggggccggtgacccggaaggtggtgctcaggtcgtcgccgtccgggtcggtggccgcgacggcgaggtccggcacggtgctgccgacgatcgcgcccgcccgcggggtgacgccggtgatccgcggtgcgcggttctgcagtgacagcgtgcggctgaccgtccccggggcaccccggttgtcggtgacggtgagggtcaccgagggggcggcgacgccggcgaaggacaccgtggcggtgcggccggtggcgatctggcggccgccggaggtccaggtccaggtggcgatcgacccgtccgggtcggcggaggcgccgccgtcgagggtgacgcggttgcccgcgccgctcagccgggtgtagccgaacgcggcgaccggcgccctgttgaccggggtcggcgtgggcgtcggggtcggggtcggcgtcggggtggggactgaaggctcggccgggaaggggtggttgtgcaggtagagcgcgactttgccggccatggcctgctgcccctgcgccagcgggtgggcgctgaggctcttctgcccgctggccggggtgatgctgcggacccaggagtgctcggtgcacagctcgtggccgctcagcgcgtcccaggtgctgacataggtcactccggcggcgtccgcctcggcgtgcacccgggcctccatgtcggcgatcaggccgtccagcttggccaggaccccggaggcggcccagaggcaccggccgtccgcgcggtagccggtggcgaacagccgcggatagcccaccacgatcaggcggccgccgctgatctgctgcttgatgtcccggtagacgtcgcgcaggcagtaccgcccgagcgagtcgtcgttggccgcgcagtcgcccagcaggccgatcttcgtcttggcggtggccatcgcctgcgtgcacttcaggccgccgtacaggtagcaggttcggaccacggcggcgaagtccgcgtcgttgccgccgatcgtcacggtggccaggtcgggccgcaccggcagggccgccagctgggcgagctgggtgccgaggccggtgtgctggctgatcgcgcggatgttcttgacggtggcgccggagcaggcgaggtgcccggcgatcgagttccggccggcggccatcgtgagaccgagggaggtgtcggcggccagcacccggccccaggcgaggcggctgcggtgacagtcgccgccggtgccggcgtcgtagtcggagtcgtcgaggtaggtgccctcgccggacgagtacgagtcgccgagcgcgacatagaagtgtcgggtggcggcggtggccggccccgcgacggccaccgccatcaccacggcccagaggcctacccaaataccgatttttcgcgacaaaacgctatctcctgtgaaaaggctgataagcgagtgactgtatgaggtgtcgagccccgcgcgcatcggcggttcggtcacgccgcatcggtcggcggcgtgacccctcgtcgtcaggcccggcgggtcgcggccagcgcggcgagcggccgggtcgtcgcgtcggcgggccgccgctggcgctccacctcgtcgaagccggcccgggccagccgcgccgagaacgcgtcgaccggccaccggtaggcggtcgccacccggtggtcgaacggcccgagttccggcgcctcgaagatgccgaccaccagcgtcgcacccggcgctgtcacccgccggaacccgtcgagcaccgcgtcgagggcgtccggcggcaggtggatcagcgagtaccaggccaggatgccggcgaccgactcgtccgccacgtcgaggctggtcagcgacccctgccggtagtcgccgtccgggtgggtcgcccgcgcgtacgcgaggaattccggcaccatgtcgattccggtcgcggccacaccccgcgagcgcaggaggccggtcaggtgaccggggccacaccccaggtcgagcacccgtccgggccggatggtcaggtggcgttcgatgaacgcgacatcgtcgggatgggactgctccaccgtcccgaaaaggtcgatgtagaccccggagagcgcggagtaggcgtcccgcaccgccgcgtgcccgtcctcccccatgaccgcatcctacgaggcggcgagccccgagtggggcgcccgtctgtcccccaccgaggcgttgcgcaccgggtgaccgggttgcctgcgtcgattttgggagctgcccggcggcgcgggtaatctctggcaacgtgaggtcgggtgctgcggccggatattccggctatttccacgagtcggcgttctatgactcggacgagcggttcctggccgtgatcgtgccgttcttcaccgagggcctggcggcgggcgagccggtgctggcggcgttcgacgcgggccgtcaggagctggtgcgcgaggcgttcggcccgcgcagcggcatccggttcctggacggcgcgacgcagtatcggcgcccggccggcgcgatccgccgctatcgggagatcttcggggagtacgtggcgggtggcgccgcgcagatccgggtcgccggggacgtgccgcagccggcgaacggcgcgccgtgggactggtgggcccgctacgaggccgcggtcaatcgcgcctaccaggatttcccggtctggggcatctgtccgtacgacacccgcaccaccccgccggaggtggtcgccgaggtccgccgcacccacccgcacgtggtggccggcggcggccacgcggcgaaccccgacttcgaggatccggccgagttcctgcgcgcccgggccggatcctggcgcgatccgctggagcggcgcccgcccgacctggagttgaccgacccgaccacgccgcaggcccgggctgccgtccgggcggtggccgcgcccacccggctgcgcgccgaggatctggacaacctgctgctcgcggtgaccgaggcggtgaccaacgcgatgctgcacggccggccgccggtggtgctgcgggtgtgggccgcgccgcggcggctggtggcgacggtgaccgacgccgggacggggccacccgatccgtacatcgggctgctcccggccgaccgggcggtcggcaacggcggcctgggtctctggatgagccaccaggtgtgcagtttcgtcggcatgcaccgcggcccggaggggttcacgctgcgactcgtcgccggcgacctcgactgatcagttcgacgcatgaaacgacgcggggccgggaatggtggccggagctggacacattctctgggggacctggtgcggcagagtgggcagcggcccggtgggcgggccacacgcgcggatctggcgcgcgccgcggtgctgatccggaccgcgtcgcggctggcccgcgtcgacaccccggacgacgtgctgcagatgctggccaccgacgcggtgcacgcgttcggggcccggtcgatcagcgcggtgatcaccgcgccgggtggtcccggattcctggccgtcgccggtgacggcgtgcggctgacccgcaatgaccggatcgcccggctcgacccggagtcaccggtggccgccgtgatgcgcgaccgctcccccgggcggcccgtcccggccggaccgctggtgctgcccatcctggtcgacgaccggacgctgggcgccatcgaaatcgacaccgacgacccggagctcgatttcctgtccgcgctgatcgcgcagttcgcccaggcctgggaccggaccgtggcccgcgccgacgccgaccgcgcccacgtccagttgcaggcgctcaacgacctgtccggccggttgggcagcgccgccgaaccggcccaggtgttccgggcgctgctcgacaccgtcgtgccccggctggcccgcggcgtgctgatccactatccgggcagcgacaaggtgccgtcgctgatcgccggcacgcacgccgaccggctgcgctggcagagcctggaggcggcggtcaacggcgatccggcccacccgcagaccaccgcaacgatcggcgaggtgctgcgcagcggggccagcgcgatcaccaccgtggacacggagtcgtggctggtcagcccgatgcaggacggcgtcgaccggctcggcgtgctgaccctggtgcgcgacgcagcccagccgttcaccgaccgcgacattccgttcgccagcgagtggagccaccgggcggcggtcgcgctggcccggatccgtgacgcgcagcggctgcgccgggtcgccgacgagctgcagagcggtctgctcccccgccggctgcccgcggtggccggcctgagcctggccgggcggtatcgccccggccggcgcgacctgcaggtcggcggcgacttctacgacgtcttccggacaggcggcgaccggctgtccgtggtgatcggcgacgtgtgcggcaccgggccggtcgccgcctcccgcaccgccctggtccggcacagcacccgcgccttcgcccgcgtgctgaccggccccgatcagatctgcgcggcggccagcgaggcgctgctgcagcaggaggagctgaacggcgcgttctgcagcatggcgtacgcgagcctgcgcaccggcggcgaccggatcaccgtcgacctggtgctggccgggcacccccggccgctgctgcgccacgccgacggccgggtctgcgagatcggcacctccggcaccgtgctgggggtggtccgcgacgtggcgtacacggtcacccgccaccacctgacccccggcgagacgctgctgttctacaccgacggcgccagcgaacgccgccacggcgaccgtttcctggctgccgacggcctgcgcgacctgctcgccgaggcgcccgccggctcggccgaggagctgctcgaccacctgatggaacggatcctcggcttcagcgaccagccgctcgccgacgatctggccctggtggccgtccacagtgaataaatctccggtcggcacccatccggcggccacacggcggcgaagtacgggcggtggcaccgcagccaccatcccgtaccggaaaggacgtacgaccaatgaggctcacccgactcggcaagaaggccgccgccgtggccaccaccgccgtcgtcgccagcaccctcaccgccgcaccggccttcgctcacggcacggcgcagccgctgaagacccggtcgctggccgcggtcctcaccgcggacaagtccggcttcgaccgcaacggccgcgactacgacatcctgaccgccgccgtgcaggcggtgctgaaggcgaagccggccagcccggtcggcgtcctcgccgacggcaacaccgcgctgaccgcgttcctccccgacgaccacgccttcgagctcctggtcgccgacatccagcacagcaagcgcctgccgagcgagaaggccgcgttcaccgcggtcgccgggctcggcatcgacacggtcgagtcggtcctgctctaccacgtcgtgccgggcgccacgatcgaccgcaaggcggctctcaaggccgacggcgccaagctgaagacggcggccggcgccacggtcaccgtcgacgtgtacggcttctgcgtcaagcggatcgccctgatcgacgcggacaccagcgaccggaacccgcgggtcaaccgtttcgacatcaacaagggcaacaagcagatcgcccacggcatcgaccgggtgctgcgcccgatcgacctgccctgacccaccccgggagcggcgcgggcgtcggcgacgcccgcgccgcttcgccttttgccggggccgggccgtcaccgagtgatccgaccatcgccgatcgcctcctgatgggatgacgacggtgctgtccttcgcgtcagacctggcgcccgttcgggtgcgtatgcactggcggcgtagagcagatcccggacgtggggcgtgttctcgcggtcggcgcgccagacgaggcgcagcgtgagcgcgggtagggggaagtccaggacggcgagggttccgtttcggacggcgtcggcgatggcgaattccggcaggagggcgacgccgagtccctgttctgcccaggagcgggcggtggggagggagccgacgaaggtccgttcggggccggggccgagcagcttgtcggcggccagggcgaaggagcagttcggcgcgttgaggagcagccgctggccgtgcaggctggtggggtgcgatggtcggcgttggagctcgtggtggggttcggtcacgagggtgagcgggacgggggcgaggtccaggaagcgtagcgatgccgccggcggccggaagccgagctcgccgagggtgctgccggtgtccagcagcagagccgcgtcgagccgtccggcgtcgacgtcggtgagcagggcgagccggtcggcgctggactggatgccgacgcgaaggtggggccggcgttcagcgagccgggccagcaccgcggggacgcaggtggctacgagggtctccagggcgccgagtcgtacgtcggatcgttgacccgtcatgtcggcggtcgcccggtctgccaggtcgagcagttggcgggcccagccgacgaggcgttgcccgtcgccggtcaaccgcatgccggtggcgcggcgttcgaacagggacacggtgagggagttctccagggcgcggatctgttcggagacactcgacggcgccatgcccagcgacaccgcggcgtcggtgacggtgccggtgcgggcgacggcgtcgaagacgcgcagatgacggagttccacgtcggggtcaaccggcctctcgtattcggtatttccgaatgccggttcggcggcaccggtggagtcgcccggggacgatcggtgagagtgtcggcgtgactccatcctcaaccggcgtttcgccggccggccgggacccggtggcggtgcgacgcggtattgcgctgtcgggtgtctcgctcggctatttcatggtcctgctggatatgacggtgctggctgtcgccgagccggacgtggcccgggcgttgcacgcgtcggtggccggtctgcagtggacgacgaccggctacacggtggtgttcggtgcgctgctgttgtccgcgggagcggtggccgaccggtacggcgcgcaccgggtctttcgtgccggggtcgcggcgttcgggctgctgtccctgctgtgcgcggcggcgccgacagtgtcggcattggtcgcgttgcgtgtcctgcaaggagcggcggcggccgcgtgtgtgcctgcttcgctggctctgatcgcccggttgtatccggatccggcgcggcgtacccgggcgatcggcacgtgggcggcgatcagcggggccgcggtcgccgtcggcccggtcgtcggtggtctcctggtggacgcgttcggctggcgggcggtgttcgtggtgaacgcgccgatcacggtcctcgtgctcgtgctggcctcgggtgcgtttctgcgatgcccggccaccgaccggcctgttcaggcggcggcccaggtcgtcctcggcgtcgcgatggccgcgggcaccgacgcggtgattgccgccgggcgggcgtcgtggctgcacgccggcggggcagcggcggtggcgatgctcgcggtggcggtgttcgcccgccgggaacggaccggcagcaccccggtgcttccccgcgagctgctggccggtcccggcatcccggccggcctgttcgtcggtgcggccgtcaacttcaccctcaacgggaccctgttcgtgctaccgctgctgctggtccaggaccgtcatctcgatgcggccggcaccggtctgaggttgctgccgttgaccctgccgttcgtcgtcaacccaccgctgaccggtcgcctggtgagccgtttcgggccgcgtccgccggtgctcaccgggctcgggctgctcgcggccggcagtgcggggctcgcctgggtggcctggtcgaccgccggggacgggtggctcgccgctgccctcctggtggtcggggtcggcgtgtcgctggtgctgcccgccgtggtcgccgtcgtgctcagcgccgcaccgccggccgccgcgggtgccgggagcggcctgctcaacgccgcacgccagctcggcgcgacggcaggcgtggcgatgatgggggcgctgctgcacaccggcgtccgcaccggcgccggcggtgcgctgttcctggccgccgtcgtctgtgcggtggccgcggcgtggttcggcttcggcggccggcggcgcggcggcccggagaaccggacaagattcgaccaaggacgattgccgcgtacgccatggcgatcttcacccgggcgatgacagcatgcggcaatgggcttcagcgagatgccgcgcgaatccgagccactgtcaccgtggcgtccgtggaccttcgacgccgaccactccagcgaattcgacctgcccgtcatccgggagcccgatcgaccgttcgaccacgagtccgatctctccttcgaggcggagcccggaacgcatgacggcgtcctggccgacggcggggagcacgagagcgacctggcggacgggccgggatttcccgacggacacctggccgaccacgtctggatgacgaaagaggtcacgatctcgatcctcgcggacgccgtgcaggcgccggaggtccgccgggccacgctgaccaccgtgaccgatcgcgcgacgatcagtgacagtttctgcgtggtgatcggcgatcacggacagctggagtatcgggcgcgacgcgagatcggcaccgtcgagttcgctccggaccggctccgtgaggacctcgggttcatcgcccggtgggccctcgaccgtctcgtcgagaacccgggcaacctcctgctgaacggcatcttccaggccgccgtgtggggcgccatcgagacgccgtgcacccggacggtgttcggcaccggcaccgacggcccgatgcagatcgcggtcttcgactgcgcccgggtgatggtcggcgaccacgcgaaagccgtggttgccgaccatcgcagccaggaggtcgccgaggtcgacttcgcccggctcatccccggccatcccggcctggtgcgggcgctcgccgaggtgctcgccgacccgctggaccagggcctccgcgacgggctggaccgggccgcgcgggccgccgcggacgacttcgccccgggggacctgctcgacgcggcggcgaccgacggcggtgcgcggcgggggcggatcgactttcccggactcttcggcggcgaggtgaccgtcgacggcgtcatcggggccgtcatcgggacggacatcacgacgagccgctcggtcgaggtccgcatcgacgccatcgcgatcaccggcgactggggcggtgagatcgagccggccgcggccgacgagaggcgccggtggaacgagctcgagtggtttctcctgcaggaatacctccgcaaacgccggccgtgacgacgtcgtgcgggaggtccggcatcgtctgccggccggcgacgggccggcgacgggccggccgtcggtgaccgggccgcggtaccgagcccgccatcgggtgaccgggcggcggggcagagtcggtcatcgggtgaccggccctgcggggccgccccgggtcatcgtcaagcgtcgccggggtcgttcggcggattgatcgggagctgcgccgtttccaggaaggccagcagcgtcgcgccgagtgccgggacccggtcgtcctcgatgaagacgaatccgtggtcggccaacaaccccgcgatggccgtggacatctgaccgatcgtgggccggtcccgttcatcgatggcaacactgatcatgacggttctctccctcgttccgggccgccggacgcggcggccggtaatgcgacagacattcatgactcgtcttttccggtagcgggaatccggcgtgggcaacaatcggctcgacgccccggaccccgctgcgcgagatcgctctagcggaaagcgtcggggccggcattgcgcggctcgcggggacgcggggccgggaaccgctggcaggcgtggcagtccagcgtgcggccgcagcgggggcaccagcgcccgcggttgtgacccacgagcagcccgccgagcaggccgatcaggatccccgcgacggcggccaggacaagcatcgttcacctccgtgaataggttatcccttgtggtgtctgatgctcactctgataggtatcggaaagcaacgccgatcccgggaactttcgaatcgatctagaaaaatccgggtgattacctcttgacgtaccagaaagccgagcggaacctaccaagttgtaacggcggtgagtgacagcttgaaaggggacgaacgtgacagcttccgagacgaccggatccaccatcccccggcgcacactcgggctcgcgctgcgaaaggcgcgcgaggacgccgggatcacgatggcggcggcggccgacgtgatcggacagtccgtgcagagtctccgccgcatcgagcagggcaccgtctccacacccaagggcaaggtgaccctgttgtgcatgcactacggaattccgaaccagacccgcctggtgtacgagcagttggcgctggagacaagatccaaaggctggtggcagtccttcggagacgccgtgcctgcctggttcgagctctacgtggtgctggagcagaccgcggaccgaatccgttcattcgacccgctgctcgtgtccgggctgctgcaggagagcggctatatggatgcggcaattctggccgttgaaccagacctgaaagccgacgaagtggcggctcgcgcagaggtacggcgctcacggcaacggcagctgacccgttccttcccgcagcccccacaactggacgtcatcctcaccgagccggtcctgatggtcgatcttcccgaaggcgtgatgcgcgcacaactgtggcatctgttgaaggcaaccgaactgcctcacgtgtcagtgcgcgtcataccgctggcggcgggcttgcaccgagcgtccgttaccggcccgttcacgctcttggactttccgatcgaaggcggcaaccggccgccgagcacggtttacagcgagagccagaccggtgcgatctaccttgaccgcccacacgagatagaggcctacgagcgggtctggaatgggatcgacgccgcagcgctcgaccaggcgagatcggtaaagttgatgtcccagaggttgaaggagctgaacgatcgtgagtcttgatctgtccggcgcggagtggcgcaagtcggcacgatccggcggaagcggccagtgcgtcgaggtcgccttggagctgccgagtgcgccgggcttcgtagcggttcggcacagccagcgtccgagtgccgaggtcatcgtctataccgacacggagtgggccgccttcctcggcggtgtccgcgacggcgagttcgacaagaagtaactacttcttcccctgtgcccgccctcgcctggggcgggcacaggttttcctgccgctacccgcctcggctgccccgtggcaggctgcgctcaagccactcaccgagggagccgaagctgatgaccatcgatctgacggtcgccaactggcagaagtccacacgctccggcggcagcggagagtgcgtcgaggtggctcttaacctaccgaacgcgcccggtttcgtagcagtccggcacagccaccgccccgacgccgaggtgatcacctacaccgacgccgagtgggtggccttcctcggcggagtccgtgacggcgagttcgacaaaccgtaggcatgcggctcggcgcttcctttccgcgggatgccggaccaggcacgacgggaacgatggccgggcgcggtccgcgggaacggctaccgcggcgtcgtgccgggagcgaggttggccgaccagcgttcctcgacgcggccgaatttccagatggcgatcgcgagcagcccggtccgcgcccagaccgggcagagcatggacgacctgatcaaggaactcaccctgctgatggccgaccccccgtgagcgtgccgatcaccggccggccggggccggactgaccgggacggccgggccgcgacgtggccggatcaggccggcgatcgtgtcgagggccaggaaggcgagcagcgggatgccgaacagcggcaggaaccagccgaccgcgaagagcagcggcagtccgatgacgatcgtccacgccggcaggccggtccagttgccgccggccggcgcggtgccgaccggggcgcggcgggcggcgcgggtcgggcggcgctgccaccacatgcggtagccccagatgatgacgcagatcaggccgagggcgagggcggcgaggagcagttggttgggcaggccgaacaactggcccatgtgggcgtagatgccccactgggtgagcttggcgagcagcggccagtcggcgaagtcgatccgctgcacgatcctcccggtgctgtcgacggcgacgctgtcccggccgaccggccagcggctgtcgatctcggtgacgctccaggcggtcttcgggtcggccggcacggtgatcgacagtggtccggacaggcccgcggcggtcgccgcgccgtacacgccggtgatcgccgccgggtcgaccgtgccgccgtccgcgccacccatcgccattgcggcgtggtgcccgccgctggcggcggcggtgccggtcaggtcggtggtgaccgccgggcggctggagttcatcgcgtcgatcaacgcggtgaagttggcaccggcgtggttggaccaggtcaggccggtcgcggagaggaacagcaggccgacggtgatccacaggccggtggcggcatgccagccgcgggtgcggcgcacgcccttgcgggcggtcaggtcggggacgaacatccgccgcttccggtcccgctggcggcgccaccacagcagcacgccgccgagggcgaggacccacagccagctggcggccagctcggagtagagcgcgccggtctcgcccaggtgcagattggcgtgcaggttgtcgagccactcggtgagcggggtggccgcccaccaggtggtgagctgaccggtgacccggccggtgtacgggttcacgtacaccgtgtgctggtggtcggcgtccagtgcggcgtcgctgaagtccacctgggtggtggcgctcccctcccccggccgtacggtgagcagatccccggccgggtgtgccgcccgggccgaggcgacctgctcggccagtggcagcgccgggccgccggggtcggtgaccaccagctcggcgcggtaggcgaggtgttccagttgcgggatgaacgcgtacaacatcccggtgatcgccgcgaccagcagtaacggcgccaccaggaggccggcgtagaagtgcagacgcaccagcagagcgccgaaggcggacggccgccggccggatttcacgggtgtcgggtcggtttcgggcacggcgagatcgggcgtcacggccatcggctgtcctcgtccaggcgtcggcggcgcgcgtcgggcgcaccggcatccaaggggttgcagtcgacgcgccgggcgtccccggtgaagcgtcgtcccggtagtcgcccgaacgtggccgatggttcccggcgatgcagcagatttcccggatcgaccggggggaaggatcaatgaggtgacggtgactcaccatcggttcgacggcatgctcggcgcctggctgcgcgcctggacccggtcccgcgggacgccggtcccggagacggtccccggcggctggcgtgtcgacgtcggactgcccggccaccgccagcggtatctgctgcacacctacgaccggcggtccctgtccgacctggcccgccgggagagcgccccgggcacctggatcaagacggccggcggcgaggccgacctgcacgcggccgtcccgcccgggtgggagcgcgccgacacttaccagttcatgacgatcaccttcggcgcgcgcccactgacgctgccatcgacgtacaccatggcaatcgaccgaaccggtccgctcagcaccgtcacgatcatcggcgagcagggggatgttgccgcctcggggcggctggtggccgacggtgcattcggcatggtcgaccggatcgagacggctgccgggcaccgccgccgcggcctgggcaccgccgtgatgaacacgctggcccgggccgcgctcgacggcggcgcccgcaccggtgtcctgatcgccaccgacgacggccggcagctctacgagtcactcggctggtccgctcgcgtcccgatcgccgccgccttcgtccccgaagtcacggactcctgacgtgcgcgctcaggcgtcgaccgtctccagcgacggcgtccgcgagcggcgcagcgcgtcgagcgaccagcggcccgcgccgaccaccgcgatggccaggaacgcccagcagaacagggccggcgcgtcgccgccgttctccaacgggagcaggccgtgcggctggtgcacggtgaaataggcgtacgccatggagccggaggccaggatcgcggccggcaccgtcagcaggccgaccagcacgagcaggccgcagaccagctggatgacgccggcgtaccagccgggccagctgcccaccgccgccgcgtgcccgctgccgcggttgccgccgaagacgccgaacaccgtcgacactccgtgcagggcgaacagcagcccgatcacgccccggaacagcgcccagacagcctcgctgaagggattcccgcgcatccgtaacctccactcccaccgtgcaaatatttacggatattaatgggccgcggcctattggcatagagagacttcgatgaacctcgcgcgtcctagctcccttaacgacgcagcgcccggtaaagccgttggcgtcacgcgggccgccgcctactttctggtgatgcgcccacaactgacgaccctgaccgttgaagcacccgacccggccggaccgggccggttctgggccgccctgctcggccgcgagatgatcgtggacgccgccggcgtgcgcctgccgggcgacgacacccaggtcgggctgcggttcgtggccggccgcgccggccggctcggcaccaaccgcatccacctgcacctgaccagcgacgacccggacgatcagcagcggatcgtggcggccgcgctcgacctcggcggccggcacctcgacgtcggccagcgtcccgaagagggacacatcgtgctcgccgacccggcgggatacgagttctgcgtgatcgaacccggcaacgacttcctggccgggtgcggcccgctcggcgaactggcctgcgacggcacccgggaggtcggcctgttctggagccgggcgctgggctggccgctggtctgggaccaggacggggagaccgcgatccagtctccgcacggcggcaccaaaatcgcctggggtggcccgccgctgcgcccgaagaccgagccgagccggcagctgttcgagctggtgaccgactcggtcgacgaactgctcagcctgggcgccacccggctgggccccggcctgctcgccgacccggacggcaacgagtttcggatccggcccgcctgatcgtcgcccccggccacgggtgtcacctgaacagcggatccgccggcatcgacgactttcctaacgttgtccacggtggcggacggagatatcgggtgaccgtgtcgaactcccggggcgtgcaggtcggcgatcacaaccagcagtacaacgtgttcggtgaggtggcgaacttcggcggtgagctggcccaagccacagcggcgcggttccggtcacgcggagatgaccgccgatccgtttactgccacagattaaattattaatctaatcttgacatgcctgtaacggcggttgcatgctgggcccccgcagcaaggaagtccgttcccaacggaggtccctgatgagaatcccccgtccgttctgggccgtcagcgccgctctggtgctgatcggcgcgggcatcgtccacaacgcgtcacccgcgtcggcgttcccggccaccccgaagtccaccgtcatcaactacctgaagtcgatcaccggcacctcgatcgtctccggtcagcacaacaaggaaccggccagccagcccgcgcagtacaccgcacaggtcaaagccatcaccgggcagtaccccggcctgtggggcggcgacatgatgttcacctccaccgacatcgccaaccggcaggccgtgatcaaccaagccaggaccgagtgggccaacggctcactggtggcgctcacctggcacgcctgctcccccaccgtcggcgccagctgcaacttcgacggcggcgtgaagaccagcatctccgacgcgcagttccagcagatcgtcacgcccggcaccacgctctacaacacgtggcgcagccggatggcggcggtcgtaccgtacctgaagcagttgaaggacgccggcgtgccggtgctctggcggccgttccacgagatgaacgagagctggaactggtggggtcaccggtcgggctcgaacggtagcctcaagctctatcagcagatgcgtgactacttcaccagccagggcctggacaacctgatctgggtgtggaacgtgcaggacaacccggccggcggctggggcgacttctaccccggcagcaactacgtcgacgtggtcactctcgacgcctggtacaagagttacccgtcgtcggcggactactcgcagatccagtcgatcgcggccggcaaaccgatcgcgatcgccgagatgggcaaggtcccgaccagcagcctcttgaccagtcagccgaagtggacctacttcatgatctggtccgagcagctgcgcggcagtaacaccaacgccgagatccagacggcgtacttcctgccccgcgtcctcaaccagggcgagatccgcctgagctgacccgatccgtccgactgtggccgccgaccctcccgtcggcggccacaacctcgagaaagacgaagatgaaaagatctttcgcctacgtggtggcagccttgtcgttgtccggaatgctcgggtcacccgccgcggccagttccggtcactcggcctgccgacgcgcggccggagcgggcgagcagaccgtcggggtcaccttcgccggcaccgaatacccggtgaccgtctacgtccccgtcggagtgcggccgggcaccaggctgcccgcgatcctcaacctgcacggaacgcagagcaacggtagcaaccagctgcattacagcgacatggcagccgcggccgacgccggccgtttcctggtcgtggcgcccagcggcaacatcccggccgctggcggtttcgcctggaacgtgcccggcgtgggcactcccccggccggcgcccgcgacgacgtcggcttcctcagcgaggtgatcgccacagctgtgcggtcgctctgcgccgacccggcccgcgtctacggcaccggctactccggcggcggccggatgatctcggcgttcgcgtgtcaccgtgccgaccggatcgccgccatcgcgccggtcgccgggctgcgcgccgggcgacccgacccactcgacaagaccagacccgacccggcgtcgtgccagcccgtgcaacccgtaccggtcctcaccttccacggccagcaggaccacaccaacccttaccagggcggcggctcggaatactggagctacccggtcccggtggcgcagcagcggtgggcgcagctcgacgggtgccgcggggcggctcggacggtcgcggtcagcacacacgtgacgcggacgtcgtaccggaaatgtcgctccggaagtgaagtcaccctctacaccgtcgcggacggcgggcacacctggcccggcaccccgatcgacaacggcaacggcatggtgacccaggagatcaacgccaacacgctgatgtggcagttcttccggcgccatagacttcgcagtttctgatttccaggtgcgggccggccgccctccccctgtgtgaccgagaatttcaaggacgggtacggcctggcggatgtggcagcggggcggcgctgcgctcctggctggtggcgatcgccatgcgccacgtccggcggcactggcggctgcgccgggcagcgccgccgcgcacggccgtgaccgacgccgagctgaccgccgatcccggcgccgacttcgtcgacctgaccatcaccgctctgcacctgtccggtcagcgccgcgaggtcgccgaggccacccgctggcgggaacccgacgatcgggagctgttgtcgctgtggtggctggaggcggccgggcaactcaccggaccagaactcgcggccgcgctcagcctgacgccggcccaggcggcggtgcgggtgcagcggatgaaagcccagctggagagggcccgctcggtcgtccgggcggtgtccgcggtgccactgtgcccactgctcagtggcgcgacccgcgactggggcggccgcccggccgggctgtggggcaagcggatcgcccggcacctccgcgagtgcgcgacctgcgatcgcgcgctcgcggacgtgatcccggccgagcggctgttggccggcctgccgttgctgcttccgcctcgcgtgttcccgccactgcgcgggccgcggcacaccgcccgtcggtggctgcccggcgtctccggcgccgcggtggtgctggtcggggccgtggccggggtcgtgctgacccggtcaccggagcggacgccggtccctcaagcgcggacagcaccggcagccacggccgcggcgaccaccaccgcggcgaccaccaccgcgccggcatcacgcccgcaccggtgtcgccgtcgacaccgagccggactccggcgaagcagccgccgtaaccaacgccccgtttcccgtccgggccgcgttctactatccctggtacggcgagaacttcaccgaggtcggcacacacttccactcgtcggcaggccggcattcggtcgacgacccagccaccgtcacccgccagatcgaagacatgaggtacgcggggctgcaagccggcatcacctcgtggtgggaggactcatgctcgtcaccggccagcccaccacaagaagtgaaccccgtcgcacgggtggaagcacgatttcagggcggtgactgggcggcgtacagccgggcgtaggcgccgccgcgggcgagtagttcgatgtgtgtgccgagctccacgatccggccggcgtccagcaccgccacccggtcggcggtgcggatcgtggacagccggtgcgccacgacgacggtggtccgcccgtgcatcaggcgggccagcgcctgctgaacctgctgctccgactcgccgtccagggccgaggtcgcctcgtcgagcagcagcacgcgggggtcgcggaccagcgcccgggcgatcgccagccgctgccgctggccgccggagagccgggcgccgcgttcccccaccacggtgtcccagccggccggaagctgctccacgaaatccagcgcgttcgcgtcccgcagtgccgcccgcacggtcgccgccggcacgtccgcacgcccgtaggtgacgttctcccgcaccgtgccgtcgaacagcaccgattcctgcgggaccacggacaggaaccgccggtacgtacgcagatcgatctcctccatttccactccgtccagcaggatgcttccggacgtgggccgcaggaagccgagcaacaggttcagcaccgtggatttgcccgccccggacgcaccgaccagcgcgatcgtctcaccgggcgtgatgcgcaggtcgatgccgtcgacggccggggcgacgtggggctgcgggtcgaagccgtatcggacatcgcgcagctcgatcgcgccggtcacctgggtgacgacgcgtttgccctcgttgtgctcgatgtccggcgcttgtaggacttcgccgatggagcgcaacgactccaggccccgggtgatgatcggggcgaggccgaacagcatcacgacggccgaggtcagcaacgcgaaatagctgctgagcaggaccacgtcgccggcgctgacgggcagcatcccggtgtacgcggcccagcccgcgccgaccaggcaggcggcgccgagcaactggtaggagacccaggacagcgcgccgagccgcccgttgatcaagtcgagccggaagccggccgcgccgacctcctccaccgttccacggacccggtgcagggccacttgttcaagcccgtgcgcccgggtgatcggcatcaacgtggacatttcgccgacgcgagcgttcagctgctccatccgccggcggaactgttcgttgcgggcgcccgacagtcggcgcaccaccgcgacgaggcccgccgccaccggcacgaccagcaggaacacgccgacgaactgcggtactcgcaacgcggtgagggtgagcgcgccgagcaggatgaacagtgccgaagcgccggtctgggtgacctgctgcagcatcagttccacgttctcgacgtcgcggacgaccttggtctgcgcgaggctggtgccggtcctggtgtggtagccgatcgacaggtgctgcaggcggctggccagcatggaccgcagccgggtgccgaggctgcgcacgatccggctcatcagccggacccagagcatggtcaccggcagattctgcagcagcacgacggccagcacggccgcgttgaaccacagttgccccatcggccggtgttccacgacgacgtcgatgatgccggcggtgagcagcggcagcagccagaccgggctgtccttgatcccgaaggcgagcagagcggccagcacccgccaccggctgggcgccagcagccgccatgtggtgcgtagcggccggctgccgtcgaatgacgtgtcgagcggggcgatcactgcgtcgggccgtggtcgcggcactcggccaggtacttcccggtgcggatcgctgcggcggtaaccgcttcgtcgcccggcgccgtcgtctggatgttgccggcgatgaccggggtgagcagtgccttgcgcacggcggtggaggtcctttcgagggggtgcgcggtgcccgcccgccccccagaggggcgggcaccgcgcggctcactgtccggcggggtacgcggacacgttgtcgacggtcagccggccggagtcgctgccgccgaggtagatcgacagttgggtgaatttccgcaggtcgagcgccccggacggagcccacggcggctgcgcgaacgacgtgaacggcacccggacgacgccggagggcgtaccggccgggagggtgtgctcccagtagaccccgttggcgacgaactgaagggtgatgcttgcctgggtcgcggagcggttcagcacgagttcgatgccctgttgtccccacaggtcgaccggggtggtgaaggtgtggctgacgcccgcgtagccggagctgcccgcggtcacgtcgagttgcatggcgtgaccgctaccggaggacgccgggatcagcgtgggtgtcaccacgtcgccaccggtgttgcgcgggtaggcggcggcgagcgcggcgctgtcggcgtatccctcgaagtcgtcgatcgtggccggcgccgacggcagggcccgcgtggcgaacgaggcgaccggggtgctgctgctgccggccgcattggtggcgcggacgctccagtaccaggtggtggccgggtcgagcccgtgtgccggggtgtgagtggtggtggccagcccggtcgcggtgagcaccgggtcgctcaggtcgggatgccgcgagacggtgagtgtgtagtagccggcacccgccgacggttcccaggcgaaggcctccgggccgatcacgtcggtggctccggcggccggcgcggtcaccccgaaggccgcgggccggccggtgatcggcgcggggtcggccgcccagaacgtcgcaccggtgatgccggcgcgcccccgtccggtccagaggacccgcacgtgggcggagccggccgtggccgccgtgaccgagtcccggtcggcgtgcgacccgacggtgcgccagatcaccccgtcatcggagacctggatcgccagatcgtggtgccggtctgcggcaatgtcgaaccgcaccttgcgggttccggcgtgctgccagctcacccaggcgggcccgttgccggtcggccgcacggtggcgtggtcggtgccggggtgaatctccacgccggtgtggccgctggtcaggccgaagctctccagcgggtcgaccagcacggtgtcggtggcgccgacgtactgcggctgcgaccgccggttgccggcaacaacgcggtaccaggcgttgccgggcgcggtgaggtcggtccacggggtgtcgtcgtcggtgagcagcccgttgtaggcgggctgccaggggccgcgctcggtcggcgcgcgttccacccggtagccggcggcgccggcggcgccgcgccattgcaggacattgaggccgccgcgcttgtcgatcgcagtgatcagcggggtaccggcgggctgcttggggatcgaggcgccgagggctttcgcgtacgcgatctgcgcctggttggcagcggtcatccgcgcgtcgtcgccggggtagtggaaggtgaacccgtcgtcgtgctgcacgaacccggagcggtcgtggtggccgaacagcgaccaggacagcatcccggtgacgttgcggtcggtgaccagggggtcaagcagggcactgccggcggcggtcgaagcgtactccccggcgatgtagaccttgccggccgcggcgacggtggccgcgtcggcttgcaccttggccgcggtcggcgggtagtagtgcacgtcgacgatgtcgacggcggcggcgccgagggtgtccgggtcgatgtcgaaccggcggccggcggcgatcagttgccggggtgcccagccggcgaaggtcgcggcgttggcgccgatccactccggggtcatgccttccagctcgttgccgagctcccatgccatgatcgtcggatcgtcgatgtagcgcttgccggtgagcgggttgacgtgctgcatcacgtgccagacgtaggcctggtagtccgcgatgacccgggggtcggtatagaacgcggcgtcgggcagcccgtacggcttggtgaagtcggcgtgcccgccgtggtagtacgcccagttgtcggtgagcggcaggatcagccggatgccggcctgaccggcgtacgcgatcgcgtagtcgatggttttgaaggcgtcgtcgttgtagccggtctccttcgacggcagcagcgtcttggggtggccggaggacaccagcatgtgtgaccggatgacggtcatccccatgcccttggcggtgtcgatcgcgtcgcggatgcggaaataggtggggtagtcgatcccgcccacgttctcgtcgaggccgagccagtaggcgttggtgccggcgaagcggaacggcttgccgttgagccgcagttccgcgccggcgcgggtgacgaagccctgacgtggtggggtggcgtaggcggcggacggaacggtgaacacgctggtcacgagggtgaggacgatcgtcgcggcacgcagcagtctcaattcttaccccggttcaggacggaggagaggtcggtgagcacccacggggttttgaccagcgtggggtcgagctcgatcggtgcgcggacgtggaacacagtggactcgccggccagcagggtgacgaagccgcggtcgacggtggcttgcgggtggatccgatcgggctgcagcagcaggtcgcgggccagcccgacggcgcgcacgtgcacgtcgagaccgcccgggacggactcgacgtcgatggtgagcgccgggtcgtcggacgagtattcggtggggaaccagagcgcgcgagcgtcgtcgagtcgagccaccagcacctcgccgaccaggtcggcgggcaccgggatcagggtcaccgatcgcgcggccaccgacacgtgctggacggtggaggcgagcaccgcgccgccggtgtcctgccgctcgatcagcacggttccggtccacgcggcagggtggtcgttgagcaccgccacgaccagggcacggtcacggggctggatggtgagcgcgcgcggggcgtagagctcgtgcagcgcgtggtagagcggcttgtgtcggcctgcgccgtcgatcgcggcccacgaggtgaccggccacaggtcgttgagctgccagaggatgctgccgccggtgtgcggccagtgcgactgccagtgctcaaccccggtccggatcgcacggacttggttgagctgggtcagatagtgccaggcctcgacgctcagcgatgccgggtcgccgaagtgcggggcgaggccgcgggccagtttgccgttgccgtcctcggccttctggtggtgcagcacgccgggcgagtcgggcagcatcggctcgtcggagaccgcgtcgcgcagcgtcgtccacgccggcggcgcctgccagccgaactcggcgacgaaccgcggcgtcgagttgcggtagttgaggtagtcctcgcggttccacacctcccaggagtggaaggtgccgtgctcggtgtcgttgggcgcgtggtcccaggagccggaccaggggctgccggcctggtagggccgggtcgggtcgagctcggccacgatctcgggcagcgtctcgaggtaatagcgggaaccccaggtctcgtacttgccgtcggcgttccacggcatggccaggtgcagccacaggttctcgttgttgccgttccaggtgatcaggctggggtgcggggcgaggcgcgcgacgttctcccgggcctcggcgaccacctcggagaacagcggctcctcctcgggatagtcggcgcacgcgaacaggaagtcctgccagaccatcaggcccagctcgtcgcagacctcgtagaagtcacggctctcgtagagaccgccaccccacacccggatcaggttgacgccggcgtcggccgcctcacgcagccgaagctcgtagcgcgcccgggtcatccgggacgggaagatgtcgtccgggatccaattgacgcccttgaccaggatcggcgcgccgttgaggtggaacacgaacccgccaccggtctggtcgatcgcgaccgtgcggaacccggtacggcgctgccagcggtccagcacggtgtcgccgtcgagcagctcgacgctcagctcgtagagagccggttcgccgtgcccgcgcggattccacggcgtcaccgccccggcatcgacgatcgcttgcgcgaccgtttccccatcccggatctccagtacggcgatctcgtacccgtcgagcagcacccgcgcgtgcagatcgcgatctcgggtccgttcgacgccgacggtgaggtcgagccggccgaggccgtcggcgtaggtggcgagagggcggacctcggcgaggcgggctgtgctccagccttccaagcggaccgggcgccagatgccggcggtcaccagcgtcggcccccagtcccagccgaagctgcaggccatcttgcggatgaagttgaacggctcggggtacgcgttgtcgcgcgcgccgagcagctcgcggacccgttcggcctcggtgtaggcggactcgaaccggacggccagcggccgcggatcaccgtcgagcagatcggtcacgtcgtaccggaaactgcggtgcatgttgcgggaagagccgagcgtggtgccgccgagttcaacggtcgcgaccgtgtcgaggccctcgaagaccaggtcgatccgttcgtgcgcaggcccggtccaggccacctcgcggcggtaggtccagtcggcgcggcccacccaggcaaccgcgtgctcgttgtcgtcctggaacgggtccgggatgcgacccgcggcgagcaggtcggtgtgcacgcagccgggcaccgtggcggggaggtcgacgccgtcgccgtgcaactcccaggagccggccaggtcttgcactgaggtcatttcgtggctcccgcggtgatgccgttgtagatgaagcgctgcagcagcaggaagatcaccacggtcgggacgatgacgatcatcgtgcaggcggcgatggtctcccactgcgctccgtaggggcccttgaaccggaacagcgcggtggagatgacactgaggtttggtgaacgcagatagaggaaggggatgtagaactcgttgtagatggcgatgcccttgatgatcacgacggtggcgatcgccggtttcatcagcggcaggatcaccttgcgatagatggtgaaccggccggcgccgtcgatcatcgcggcctggtccaggctctgcggaatcgactgcatgaactggatgaagatgtagatcgacacgatgtcggtgcccatgaacagcacgatggccgaccatgaggtgttgaccaggcccatcgacttgacgatctgataggtggccacctgcgtggtcactccgggcaccaacgcggcgaccaggaacaggcccagcaccaggcgcttgaagggaaagacgaaacgacttatcgcgtacgccgcaagcgtgccgatcgcgacggtgccggtcagcgacaccaccaggatgaaggtggtgttccagaagccgcgcaacatgtcccccgcggtccacgcggtcgcgaagttgtggaagttcagccagttgtgcggcggcgtgagcgggccggtgctgttgtactcgacgtgcgtcttgagcgaggcgaacaggacgaccaccagcgggatcagtaccaccagcgacgccagtaccagggagacgtatttcgcggtggtcgccgtccgggcgacggccaggtcgcggccgccaccgcgcttgaccggggccggcggcctcggggacgcgtgccggggtgtgcgggtcgcagtggtcacgacagggtcacctcctcgtcgggcaggacccggcgctgcacccaggtgatcagcaggacgatcagcagcagcacgaccgccatggccgaggccaagccgatctgccggaactggaacgccgtctgataggcctggacgacgaacgtgcgggtgccgttcgcgccgccggtcatgatgaacgggatctcgaagacgctgaggctgccggagatcgccaggatgaaggagaggctgatgatccgccggatgccgggcacgatgatgtgccggaactggtgccaccggttcgccccgtcgatctcggcggcctcgtagatctcgcccgggatcgactggatcgcgccgaggaacagcacgaagttaagcccggtgaaccgccacaccgaggtgccggccagcgagatgttggcaatgtccgggtcaccgagccagagctgggtgtgcccgccgagcccgaccgcaccgagcagcgtgtccaaagtgccgtccggctggaacaggtagaggaacacgaagccgaccgcgaccccgttgagcaggtacgggaagaacaggatgcccttgaacagattcttgaaccggaccttgaacgagagcaccaccgcgaagtacagggcgatcgcgatctgcgcgaacgacgcgacgaagtagtagaggctgatcaggaagacgtgccagtactgctcgtcggtgaacacccggacgtagttgtccaggccgaccgggtccatggtgacgtccaggccgtcccacttgtggaagctgtaccagatcatgttgccgaccggcacgtacgtgaagacgatcagcaggatcagcgccggcgcgacgtacacgtagggggtctgccagaaacggcgccggcggggcttgccggccgcccggcccgccgtggtggcgggccgggcaccgggaatgacctggctcgtcacttcatgacctggctctgggcggcactccaccgcttgttcaggtcggcgaagtaggactccttgtcacccttggcggcgccgcgcgcgatgtcgaccagcttctgccggtagatcgggcccttcaggtcgatctccgacgtccggatgatctcgtcctccttgccggcgttcgtagtggcggccggcacctcgatcagctcgacgccggtggcggtgaactcctgcaggcccttgggtagcggctgggagacggccggcgggatggcctgctggtcggcggcgaagccggactcgttgacgaagaagtcgagccaggccttggcggtcgccttgttcttggagttcttgctgaccgcggcgagcttgtcaccgtcgatggcggtgtggaacttgccgccggtctggtacgggaacggccagaagccgatgtcggccgggtccgccttggcactcttggcggcttcctggatctgcgggacggcccacgagccgagcagcatggtcgcgaccttgccgctggcgagcatcggcttggagctctcccagttggtcgtcagcgggtccttctcgctgagcttgttgtgcacgatgtcgtagagcaggctgtcggtgatgtactggatcttcccgggctgccaggggctggcatcggccgggaacttctcgttgatctccgggtcgccgagaacggcccgatagctgttccactcccccagtggccagccgtccttgtagttggtgtaatacgggatcgcaccggtcttggcggcgatcgccttgagcccgtcgacgaactcctccggggtcttcggcggggtggtgatcccggcctgcgcccagatccgcttgttgatcacgaagcccttggcgatgccgccgaccgacagtccgtacacctgaccgttgtaggtggccgggccgaggaatcggtacttggccttgagctcgtcctgggtgccgagcggctcgaagaactggctgtactggtcgacggcggcggtgcccgggatcatcagcacgtcgccgtagtcgccgctgctgagctgggtggtcacgtcgtcgtcgtagttggtgacgccctggaaggtgaccttcgtaccggggtacttggcctcgaacttcttggcgtattccggcagcgtcgtgctgaccaggtcggtccggttggtcagaacagtgatgttgcccttgatgtcgccggagaagtcgccgctggtgccggtgtcgtcgctcgcgccgccggtgcacccggcggtgagcgccagggccgcgaccgtgccgaggccgaggaacgtccttctattgatcatgccgatatccgtcctgctggatcagctcgctgtggagcgcccagcatgagacggacgttacgtcggtgtcaagattagattattaatttattcggtgctgtaatctgaccgtctcgtgcgggagcggttctccctccgcgccgcgttcgggacagaaaacggaggtggcgcgccccatggcacgtcgagaagcgcccgccgcggggcccggaagccgcgccctgatcgtcgacgtcatccgctccgcggtgaccatcagtcggggtgagctcgtcgacctgaccggcctcacccagccgtcgatctccaacatcgtgcgcgagctcatcaccgacggcatcattcacgagatcggctcgctcgactcggcgcacggccggctagctagctagcccgcaagctcatcgcgatcaacccggccaaccgcttcggcatcggcttccacctcggcccggagaccgtcacctgcgtcgcggtcgacctcaccggcggcgtggtcggccgcgaggtcgtccccctgctacccgatgaaccgtggcacgccgaccggctggccgaccggttcgagcacttcaccgccggtctcgacctgccccgggaccgcatcgagggcctggccgtcgtggcgcccggcgcctggccgcccgaagtgcgccctggcctggtggaccgcatcggggtgccggttctcgtcgagaacgacgcggcggccgcggcgctcggcgagttctggagccgccgggtctcccgcgaccaggtgttcggctgcgtctacctgggcaacgagatcagcgccgggctggtcttcggcggcgcgctgttccgcggcgccagcttcggcgccggagcgttcggccacatgtcgatccaccacgagggccgcccctgcccgtgcggcaaccagggctgtctgcagcagtacgcgtcgacccgggcgatcgtcgaggctgcccgcgaattgccggagctgcgggcccggctgcccttggacggcaccgagtccgccgcgtacgaggcgatcgcgcgggccgcggtcaacggcgacacggatgcctatgccgtactggatcaggcggccgggtggctcagcacggccgcgacctcggtggtcaacctgctcgatctcggccggatcgtgctcaccgggccgggcgtcgcgctcgccggatcgatcttcgcccgccggctgcgcacccacctggaccggaccgcgcactcccggcaccagcacagcgtgaccgtcgagatctccgcccagccccgcgacgccgccggtatcggtgccgcggtgctcgtcatccaagcgtccgtcgcacccggccacaccccaggacgctcctcatgagaaacattcccaagatggaggaaccagtgacaccacggccacggcgcgtcggcctcgtgctggcccgggcctcgcaggtgctcggcgaggaaccgtactaccacgaattcatcgagggcctggaacggctgctgatcccggccggaatctcggtgctggtcaaagtggtcaccgaccacgccgctgagaaggccacctacgagcagtggtcggccgaacagcgagtcggcggcgtcatcatggtggacctcagccccggcgacgaccgcgtcgagctggtccgcaagctccgcctgccggccgtcgtgatcggcgacccgtccaccgcggacgggctgcccaccgtctggaccgacgacgccggatcggcgcgcgaagcgatccgcttcctcgccgaccgcggccacaccgtcgtcggccacgtcagcggaccacgctcgctcgcacacacccagctgcggctcggcggcttccaggccgaggctgccgcccggggcgtcacgctgatcggtgccgagggcgactactcgcaggagtccggccgggtcaccaccgcccgattactggccgcgcatccggtcccgccgaccgcgatcgtctacgacaacgacgtgatggcgctcagcggactggagacgatgatcaagcggggcctccgcgtccccggcgacctctccgtcgtggcctgggacgactccgcgcagtgccagctcgcccggccggcactctccgcgatgagccacgacgtcggacggatcggcgagatcgcggccaccgccgttctcgacgcgatgcgccagaactcggcagacaacgtctatgaggcgccccaggcccacatcgtcgaacgcgacagcaccggctgaccgcgcttcccgcttgaaggagcgacctgcattgagcaccacacctccggcggacaccgtccagcgtctgctcgacttcggccgtgccttcccccatccgctcggcggcgcggcctggctgcggaccgacggaacccccgatctcgacgcacccgtgcacacctggatcaccgcccggatggcgcacgtctacagcctgggcgacctgctcggcgtaccgggagccggtccgctgaccgacgccgcgctggccggcctcaccggcgttctagctgaccgcgagcacggcggctggcacccctcggtctccccggacgggctgccagccgccggaaagtcgtgctacgaccacgccttcgtcgtcctggcagcgtcgaccgccaccatcgcccggcgtccgggcgcgccggccctgctgaccagggcgctcgacactctggtgcgccacttctgggaccccgtgcaccagatgttcgccgacgcctgggacaccggctggcagcgcctcgacgactaccgggggctgaacgccaacatgcacgcggtcgaggcgatgctcgccgcgtacgacgccaccgggcggacagactgcctggaccgtgcgctggcgatcagcgaacgagccgtcagccgggggcgagaacacggatggcggctgccggaacacttcgacgcgcgatggaacgcgcggctggactatcaccgggatcggccggacgacccgttccagccgtacggggcgaccgtcgggcacgcgctggaatggtcgcggctgatcttgcacctggaagccgcgctgggcccggcgtcaccggactggctgctgccggccgctcgagccctgttcgcccgggcggtcgaggacggatgggcggtcgacggcgcacccggcttcgtctacaccactgactgggacggcacgcccgtggtgcggcaacggatgcactgggtcgcggccgaggcgatcgcggccgcggcagcgctgcacacacgtaccggcgaagaggattttgcccggtggttttcgatctggtcggactatgtgcgagggaacttcgtggacgtgcaacagggctcgtggtggcacgagctggacaccgacaaccagccggccgcgacgacgtggtccggcaagccggacctctaccacgccgtgcaggcgatgctgctcccccgggcgccgctctccccaggtctcgccgcggcgtgcgcgaacggagcggtccgatgaggcgattcctggtcgtcggcgagtccatcctcgacgtcatctccgacgagcagcgggaactgcccggcggcagcccggccaacgtggcggtcgggctgggccggctcggcaacgacgtcggcctgtggacccacctgggcgccgacccggccggtgacctgctgcgcgcgcacctcaccggctcgggcgtcgacctgctggcaccgatcgccggagtgacctcccgggcgctggccgcaatccagccggacgggtcggcgcgctacgacttcgccgtcgagtggccgcgctggccgggcggtccggcacccgccgagaccgctcggcatctgcacaccgggtcgatcgcggcgctgatggcaccgggcggcggcgacgtcgagcggttgctggtggaccgccgggacgccatgacggtcagctacgacccgaacatccggccggcgctgatcggcgacccggacgactgccgcactcgagtggagtcgatcgtcgccggatccgacgtggtaaaggccagcgacgaagacctggcctggctctaccccggcatgccggcgctcaacgcggcccggcacctgctcgccctcggacccgccctggtctgcgtgaccctgggagcccaaggcgcgctggcgatcgccggggaggtccaggtgactgtcccgccggtggccgtcagcgtcgttgacaccgtcggggccggggacgccttcatgtccgggctgctcgacggactgggggaacgagggctactcggcgccgccgcccggccacggctgcacgccatcaccggcgaagacctccgagcggtgctcagccatgcggctctggtcgcggggctcacggttgcgcgggccggcgccaccccaccgaccagggcggagctcatggtcagaaatgagcgagcctcagcgacttaaattatttaatagcgcattgacaggtccgccgcgcggccccatgatgagtccgccaggagctgcctcggtgggcggggaccgctgtaggccaggccgccagccccggatcacacccgcggcccggcccgttggaacatcacccggggcctggatggcagccgccgggccgcaagcgacctcaatgccgcaccccccccgtccaccacgtcctgaggcgtggcgctccggcgcgcatcgcaccggagcgccggggccgtcgtggacatcgcgacgagccagctcgtcttacagcgttcaggagaccgtcacgtgaaacgccgaccagtccttgtcaccctctccgtcctgttggccggcggcgccgcagtcgccgtgactctgccggcatcagccgccgccaccggtgcccttaccggcctggcgggcaaatgtgtcgacgtggccgcagggggcaccgccaacggcaccaaggttcagctgtggacctgcaacaactccgctcagcagcgggtgtccgtggcggacgaccgtaccatccgggtattgggcaagtgtctggacgtcaccggcggcgtcaacgccgacgggaccaaggtgcagctgtgggactgtttcggtaacgccaatcagcagtgggtctacaacagcgcgacgaaggacatcgtcaacccggcgaccggtcggtgcctcgacgccgccggccagtccagcgcggatggcacgccgttgcagatctggacgtgcaacagccagaccaaccaggactgggtactgcccggcggcggtggaccagtcaccccatcgccgtcggccagcggggcggcctgcaaccggaccgtgcagccgggcgagcgcaccatgccggtcagcttcgcaggcaagcaataccaggtggccgtctacgttccggcgggcgctcaacccggcacccggcttcccctggtcatgaacctgcacggctccggcggcaccggatccggtcagctgcagtacagcaacatgaagccgaccgccgacgccaaccaattcctgatcgtcgcacccagcggggcgatccccaatgccagcggcttcgcctggaacgtgcccggtgtcggcacagcgccggccggggcacgagacgacatcggcttcctcgagcaggtgctcaccacggcgacctcgaccctgtgtgccgctccgacccgcgtctacggcgccggatactccggaggcggccggatgacgtcggcgttcgcctgcgcacgaccggaccggctggctgccatcgcccccgtgggcgggctccgcgccggccggcccaacccgcagaacaccgcgcagccggatcccgcctcctgcaacccggcccggccggtcccggtgatcgccttccatgggcagcaggacaccaccaacccgtacccgggcggcggctccgagtactggcagtattcggtaccggtcgcgcaggcacggtgggcggcgatcaaccggtgcaccaccggtccgaccactgccccggtcaccacccacgtcacaagaacgaactacctcggttgcgccaacggcgccgacgtcgtgctctattcgatcagcgacggcggtcacacctggccggggacaccggtctccaacggaaacggcaacacgacgcaggagatcaacgccaacacgctgatgtggcagttcttccagcgctttcaactgccggcctgattcctctgggcgcggaactcctcacgaccgcccgccactgttcgtgaggggttccctccggtaccgacgcccgctggtcaccgattggcgttgaagtcccgcgaaacctgcagagcggtcaactcggtctggtagtaagccacctcgtcgatcatgccgacgaagtagtcgtggcccggacggttcggccagccggtgaggtgaccgccgccccagcgccagaaaccggtgtagttcccgccggccgttcccgtcgcgtcggaggcgaccagcgcaccgtccagatacagccggatgccgttggccgggctcatcgtggccgccacatggtgccagttcttccaggtggccgccgacccggcgtacgcggcggtgacgatcgtgcccgctttgttgacaccgaagaccaggcgttgtgcgctgtcgatgtagaccatccggtcggtggtgtaggtgggaaagaacgacgtctggtcggcgttgaacgccaggatctgcccgccccggttgtccgagcccttgaaccagcactcgatcgtgaacgtcgtcgggttggtgaacgagatcgggttgaagccactgcccgacccgttgaaggcgaccgcggtgttcccggcctgcccgcccagcggaccctgcaacgcgccgctgccaccggcggtcataccggtcgggatggttcgcccgtacttgtagagctggctgatctgattcggcgtcaacgccgcctggtaggtccggacatcatcgatgcttccggaaaacgggttggcccaagcgccgtagttccgcgaccggccgatctgcagccgattggtaatggcccattcgacggcgtcggtgcgcgcggtcgtgccgctctgcaccccgttgacgtacaaccgcagaagatccgccgcgtcgtcgtacactccggtgatcatctgccaggcgtctttcgtcgccaccgccgctgacttggcgcccgcggcgttggaggcggagttgtcgttgtcccacatcgccaactcccagcggtccggtgccgcctggttgtacttcaattcgaaggcagcggcgttgccaccgttctcgctgaggatcgcgcgggtgatggtggctgccgtcgacggtaggtacacccaggccgagacggtgaaagcctgatcggtggcgacagcccggctgttgctcagcgcggcagcgccggacccgtccagcgtcaacgcccctccccaccagcccccggggttccaggtggcggttcctgaggtgctgccgtcgttggcgttgccggagctgtccgcgacactggtgccgccggtttcgtcgaaccggtaatgaaccgtcggcgcctcggtcgacatgcccaggatgtcggtgctggttaccgcggactgatagacccggacgtcatcgatccggccgagccagtacgcggtcgcccaggcggtgttgtaccaggttcgccccagttggagagtgcccgacggggtccattcattggcgtcggcgtgggcggcggtggtggccgacgcgaccccgttgacgtagagcgtcagcaggttcgacgcgtcgctgtagaccccggcgaggtgcgtccaggtgtcgagtgccggagcaccgctgctcttggcggcgtccggcgtcggggcgccgatgttcgactgcgccatctcgaattcccacttgtcgtccgagtcatcgaacttgagcaggaatgcgctggtggccgatccggaaaggctgacgacggcgcggtcttgattgtcggccccggtgggcaggtagacccatgccgagacggtgaagtccgtggtgacgctgatgcccgcccgcgccgcgtcggcatgactcgccgtgccgtcgaagctcacggagctaccggggtggcccgccactgtcgtggtgccgctcagcgttgcgctgttgccgttgccggactcgtcggcgaccgccgagccggcgatgtcctcgaagtcgtaccaggtggccgggccgtcggtgcgcccgtcgtaggtgccggtccgggtgccgttcgagctggagtccgccgcgttcgacgtcgcactggaggtctgcgcctcggccagccggtgatagaagtacgcgccgtcgttgctgatcgtggtgggatagtcaggaaagctcgcggcggcgctgaaagtgttcgtcccggttgcggtggaatcggtgaacacggcccgcacgagacggaaatcggccagaccaaacgccagtgccagcacggcgaacacggcgaccacccgagtgcccgcgcggacgatgcggcctcttacccgatctgctggcatcgctttccactttcccgggcacccctcggacgtgcggcttccgaatcctcggcatgtggatcggaaatttggtagagggtggaaccgagggactttcgccattcagtctaggtgccgagccaccggtgatccgggcgtttctctcatccggcgcacggcgacccgtgagaatgggggtgacccacttctccgcggaacggcatgatctggctatccatgggcttgcaccagaagagcgtgcggcgggcgcgacggcgtcgctggcccctgcggttctggctgatcggcatcctcgtcgccgtcctggccacggtgcggtcgacgaacgccgtcttcacctcgcgcagcagcagtaccgggaacaggctcggagccggcacggtcgccatcaccgacaacgacggcggatcggctctgttcagcaccgcgtcgctactgcccggcgacagcgccaccgtgtgcacgggcgtctcgtacaccggatcggtgacgtccgcgccgatccgtctcttcgtcgacaagacggccgcgcaggagtccgacagtggagctgtttacggtgcgtgggcggacagtaccgcctcgatgatggacgacaacctcaccatgcggatcgaggtgagcagcaacgacctggccgccagccccggaagcaactgcaacccggcaggtgtcggctccttcaccgacgtcgccggaactttcggcacgaacatgcgtacgctcatcgccaccaactacgatttcgccaccggcctggtctcgcagtggggcaccgtcgtcccgaacacctggcgggtctggcggttcacgtacaccttctcgctcgccgcgactgccgccgcgcagagtgatggactgaaatgcgccttcacctgggcggcgcagaagtgatcagccgctgatcgggatgtcgaccggctccggtggcgagcgccaccggagccgctcacacctcaccgtcgactacctctgggcttcccacatggcagtgaactcgacaccgtcgccctgaacgttgttaccggcgccggcgcccaacgtgtaggtgaaccggtacgaccggtacttgccgttgcccatggtcggcacggtgtacgacgtagtcgcaccccatgcgctcttggtgctgatcagcgtccgcaggttggtccccgccgcgatgacgtcgccgaacgtcccggtacagacgctgccagggtcggtggccaggtccgcgttgttcacctccacctgcagggtgacattgtcgtccatctccgctccgcccgcgacagcgctctgccaggcgttccatgtgccgcttccggcgtccatctccttcgcctgcgtcgcgccgttgggaaagtacaacgcgaccgaggtgggagccagagtgccggtgtacccgaccccgatgcacaccgagcgcgacgcaccaggcgccagagccgtgtcgcctccgacggtggagaacatcgccgcaccgccgttgttgacgtcgatggtgaccgtaccggcaccgatccggttgccggagctgctcgtcgtggcggagaacgtggcgtgcgaggactgccagaccaccgccgcgcaggcgatcacaccgacggccactgcaatcccgcggtggcgacgatgcctctcgaccgatgcgaaggtcgcttgattgctctggcggcccatcaacacccctttcaaccgtctccttgagcggccaccccctgtgaccctcggcgtcaagttcgactcctcgccggatcccctcgagtttcgggtaagtgcagttgggttgcggacgggttgaagggacagcaaagcgcttcgacggcgcctgcgtaaggccggatccgaagcttctactcctccgccgaggtctgatcgggcacagtgtctcgcgtcatctgggggcgccgcggctgccagacgacaaggaacagcagcaggaaaccggccgctaccaccggcacgaaccggccttgctgcacccagaggaacggcaggccgatgaacgggacgcgcagccgcggaacaccacgcaggctctccagcgttaccggcgtactgtccggcgacgcgttggcatcgcccttgaggatcatccggccgtcagtgtcgtatcgcatcaaccggtgcatcaggagttcatcgggcagtgccggatcatcaaccagaacgacccgtccgggcttcacccgcgaccggggatcgtccggcacgggcgcggcgacgaccacatcgcccgggcggatggtgggaagcatcgaaccggagaccacgaccgtgggtttccatcccagcagcgccggcgcgacggagatcagcagcatcccgaacaggcaggcgaccaccgcgtcccggacgtcggacagcagattgaccgcccggagtcgtctgcgctctcgggcgccggcacgatcgctgggcaacgccgcagaccacggacgcttcagagagacacgcatctcctgcccctttgttcaggctcctcaagtatcttcggcggcctccccggcacgcctgagccgacaccgtcgcgcaccggaatcctcatcagggctcggcgccgaccgatactcgcgggcagccacacaggccggcgattcgcgttccggtctggtgtttttcccccgacagcgaggacgaccgtgaactggaccaggcgactacgagcccccggcgtgaccgccccgctcgcggtgcggccggagacatcgccggtcgccgatgtgcggccccgcgccaagcttccggcagccctggtggcgggcatggtggtgtccgccgggttggtgtggcaggcgagccacgcctcgctcgaggacacggtcaccaaccaaggcgactcgtggcagtccggcattgtggcactgaccgacgacgacaacggtgccgcgttgttcaccagcttcgggaccgacctggcgcccggaaccggatcgacgaaatgcatcgcggtgacctatgccggcgacgtcgcggccgacgtccggctctaccttgcccggctcgacgaccacggcgaagagctcgacacgttgctgaccatgaggatcgacatcgggtccggctcgtcctgcgcgtcgccgggcaactggacgcaactgagcgacaccgaccttcgtgccaccgcgaattccgccgggacctgggctgccggattgacacccggcgcgtggagcccatcgggtgaccagccggagacgcgtccctatcgcttcatccccaccctcgccgacgacaacgccgcccagggcgaccaggtcgagctggacttcgtctgggaggcacacagcacctgaacgaccgggtgaccggcgctcattaagatcagtgcggaaaatgccgacaggaaggctgtgacccggccggaccgcccgccgcacccttcgcttctgcggcgagggatcggcgcggtgctcgtggccgtcatcgcggtcgcgaccgccctgctgctccagcacaagcacacccggacacccgcaccgcaggccgatcgggtcctggcgtccatgccgctcaccggagccgcactgacggcgggctcgaatgccccgctgttcgacgtgcgacggatggcgccgggacaccgtgtcgagcgctgcatcgtcatcgccgccgcctcggggggctcggtcgtgcgattcggtgccagcggagtgtccggtgcgctggcaccgtggctgcgggtggagggcaccatcggaacggggacgtcgcgggactgcagcgatttcgcggccgacgccacgtcgttctacaccggctccatcgccgcgctgggcagcgcgggaacggagggcgtacccaccggctgggttcccgggcatgccgagagccgcacctttcgcatcgcggtcgaggtcgccgacgatgcccgcgctgcgggttcgtcggcgctcgccacgctgacctggcgatcgcaggctccgggggtgacgcccacgaccggtccggggacgagtgcgccttccctgcccggtacttccagcgcggccccgaccaccacaccgccgaccaccacaccgccgaccaccacaccgccgaccaccacaccgccgaccaccacaccgccgaccaccacaccgccgaccaccacaccgccgaccaccacaccgccgaccaccacaccgccgaccaccacaccgccgaccaccacaccgccgtccatcacggcgccggctgccgcacgaccatccgactcggccgttccgccggcgggtggtggcttgccgtcggggacggtgcccggtgactccatggcggcggctccctgcccgccgacgaccgccgcccgggtgggcgatctcctggccggagtggcccgcttctcctggctcgctctgctgctgttgctgctggtcctgctgttcctgctggtgcaggaccggctggaccgcggcgatccgaaactcgcgcacgctccgctgtacggcgagccgcaccaggccttcccggacaacggctcgatcccgtggaggacgcagtgacgctccagcctcatccctcgcggttcggcttgctgccgttggcggatcggatcagatggtcgacctcgttgcggctgggtctcgccgccatggtggccgcgttctggatcttcctgccgggccaacgccgcaccgacgggaaggatctgttcgccgtcgcgctgctgtgcgcctgggcgaccgtgctcaccgtcgcggcgccccgggtcggccgcaggatggccatcgtggcggtcaacatcgccctgctcgtcgacgggctcggcctggcgacagccctgcacgcatacggcggcgtgagcggaccgatcagcgtcctgatggtgctgcacgtctgcggggtgagcctgctgacatcgtttcggtccggcggcaaggtcgcggtctggcatgccctgctggtgttgtgcgtgctacaggcggagcaggtcgggctactgaccgtcaagcagccggcgccactaccgatggccgggtacgtcacttttgtcgccctgcttggtgccgcggccttggccacctcgctgtacgccgcgctcaatgagcgcgaactgcgccgccgacggtacgacgcagaggtgctgcggagcctggccgtgcatctggaagccagcaacgacctgggcgagatcgccgcggcgttgacccgcctggccgtcgaggatctactcgccgtccgcgcattggtagtcatcgaacccgcctcggacgaggagggtcgtgggctccggttcgtggagaagggatggccgcctctgccggccgccctggacaccggcaaaacggcgcatgctcacgggtcgctgctggccgacactgaagcgggccccgtgctcgtccgcaatctcgacaagcagcgggattcctacgtcgtcagccggctgcccggcgcggagcgcctggccgtgctgcccatcccgctcgggccggcggggcgcggtcacctggtcctggacatgggccggagcaagcgcgtcgagcaccggatgatgtccaccctgatacaggcgaccgcgcatgtcgggctcgcgctcacccgcgccggactcgtcgagcggctgcggctggccgccgaaaccgacggcctcaccggcgtcgccaaccgcaagttcttcgacgcggcccttgcccagcacatcgaccacgccatgcgcaccggtgagccgttggcggtgacgctggtcgacctcgacttcttcaaaaaggtcaacgacacgtacgggcaccagaccggcgacgaagtcctgaaagccgcggccgccgcactcaggagcaccgccagggagggcgatgtggtggcccgttatggcggggaggagttcgccgtcatcctgcccggcgtaccggtcgacgatgtctggcaaacggccgagcgattccgcaacgcggtccgcacctgtccggctcctgtccccgtcacgtgcagcatgggtatcgccagccttcctcctggcggggtgccgcccaccgtactgctcgaggccgccgatcaggcgctctaccgggccaaggaagccggccgcaatcgcgtggagatcggccacttcaccgacgaatcgctcggcacggcagtgggtcgggggcattgatgggtgcggcaccgcctctgcgacgccggcgccgcacaacctgcctgtgggcggccgggctgctgaccgctgccggaatggtcgtgcagagctcccgggcaacgttgaccagcaccacctcgagcggcggtaacagcctctcggccgggaccgtcgcgctgtccgacgacgacagcgcaggcgcgatgttctctgccaccggcatcaaacccggtgacaacgggcagaggtgcatcacggtgacctacaacggtaccgtcgcctcgctggtgaaggtctatgccgccacctcgatcagcactctccatccgtaccttgacatggtcatcgagcagggcaacggtggctccttcgcgaactgcggtggcttcaccgggtcagcgatttacaccgggacgctcagtgcgctggggaccagcttcgcgggcggtgccggcacgtgggctcccgccctcagcggtagcacgcaggtctaccggatcagctggactctcctggacaactacgccgcccagagcaaagcggccatccttgccttcacctgggaggcacagagcacgtgaaccgcgtggtacgcctctactccaggcgtccggtgccggcatgcgtacagaaacgaccgatgcgcatgaagtgggcgttcagggcgagggtcagcctcacccgccgaccggcgtgccgcatgctggcgacgatgacggcgctggttctgctcctggcggtaccagcgttcacctgtcgccgcgtccgggcagtcttctcggccaccacagccaactcctcctccttcacggcagcggcaaacttcgacgccggccagatctgggccaacggccgggcactcggcagcctggttccggcgcaagtgggcacggccacctgggctcaactgaccgacggcaccttccacaactgcggcattcagaccgacgggaccctgtggtgctggggatcgaacaccagagggcaactcgggcagggcgacaccacctaccggtacgaccccaccaaggtcggttcagccacgtggacccagatctcggccggctatgagcacacctgcggcatccagaccggtggcaccctgtggtgctggggttccagcttgtggggtcagctcggccaaggcaatcagacgaacctcagcacaccggcccaggtgggttccgcgacctggagccaggtctccaccggcggttatcacacctgcgggattcagaccgatgcctcgctgtggtgctgggggtacaacgagcggggccagaccggcaatcccgcgaccctgaccgaccgggacgtgagtccgttcaacgtgacgtccgtggccgggccgtggcgagcggtgaccaccggctctggccacacctgcgccgtgaagaccgacaacaccctgtactgcttcggcgacggcggcgacggccggctcggaaacaacagcacggccaacagcgtcgccctccagcaggtgcccggcacgacgtggctcacgccgtacgccgggcgtaaccacacctgtgccaccaagaccgacaacactctgtcgtgctggggacgcggcacctccggtcagctcggcgacggcacgtggaacacctccctcaccccggtcacggtggccggggcggcgacctggaagtcggccggcggccgcaccgtctccacctgcggcctcaaatccgacgacaccatctggtgctggggcgacaacttcgccggtcagctcggcgccggggaccagaacgcgcgcaacagtcccacctcgtcaggtgccctcacctgggcttcgctggcctccgggttcggatcccaggggacgtgcgcgatccgcaagactctgaacaccctctggtgctggggcttcacccatcaccagtcgagtacgccggtggcatacccggggacgacctacaccgccgtggcggccggcaacgacttcgcctgttcggtgcgtacggacgggacgttgtggtgctgggggcccaacgacgtcggccaggcgggatggaacctgccgtacggatatcccaagcaggtgaccgccgcgacgacctggcggacagtgaccgcgggtgaccgccatgcctgcggcacccagaccgacaacacgctgtggtgctggggatatgcgtcctccggccagaccggccagaacaacaccgccacgcagaccgtaccggtacaggtcagccaggcacccgccacctcgtggagcgccatcttgtcggccggcgacaaccacacctgcgccatcaagaccgacaacaccctgtggtgctgggggaacaactccgccggccagctcggcatggcggcgggagacaccacgaaccggctggttcccgtcaagatcggctctgccacctggagcgcggtcgccgcgggcgcccagcaaacctgcgggatccagaccgacgggtcgctgtggtgctggggcagcggcgccaacggccgcctcggtcagggtgacaccaccggctatcaagcgccgaaacaggttgggacactcacaacgtggagcagggtcacggccggcggcggccatgtctgcgcgatccagaccgatggcacactgtggtgctggggcctgaacagctccggtcagctcggcgtggccgtcggggacaccaccgaccggccctcagtgacccgggtcgggaccgccacgtcctggaagtcgatcagtgccgggcagggacacacgtgcggcacccagacgctacgcacggtctggtgctggggccagaacgggtacggccagctgggactgggcgacaccatcaaccggaccgtgcccacccaactggcggggatcaaacgccggccgatcacgtcaggctcggcggcgaacaccacctacgcgatcgaatgagccggccttcgcgcgaccgccgggctaagcgggtctcgcgctccgaacggcatcttgccgcactttgctgtccgcggcgtcggctggagtgctagtaattttcgacttttgcccgagttgtggcagcaggaacgacgcggtcaacttcaggtcttccatcggcgtcagccgccccgaggagaacctccatgtcgtcaccactcggctcacgcccggccgccatcaccctgtcccggccccgacgtacggacttggcaaaaccttaaattaataatcttagccttgacgtgtacacatgtagcttccatgctggctgcgtcctaccggaaagacccctccccccgcacgccggcggatcgccgcgacgatgtccccgtgggtggacgtccgttgccacgccaccccctccggcccgctctcatggagtcctcccttgacgagaaagacccgttctcgccgcgtcatcgcggccgtgacgttcgctgctgcggcggcggtgctgggcaccgtgatgctccgtctaccaggaacagcgagcgcgttctccgtgacgtcgaaggccacggtgatcagctacctgcagtcgatcaccgggaagaacatcatctccgggcagcacaacaaggaaccagccagcagcccgacccagtacacccagcaggctcgcgccgcgtccgggcagttccctggcctgtggggcggcgacatgatgttcaatcccgcggacgtcgccaaccggcagaccgtgatcaatgaggcgaagacccagtgggcggccggttcgatcgtcgctttgacctggcacgcctgctccccgaccgtcgccgccacctgcgccttcgacggcggggtgaagaccagcatcaccaatgcgcagttcaccgagatcgtcacccccggcaccaccctgtacaacacgtggcgcagccggatggctgccgtcgtcccgttcctcaagcagctcaaggacgccggcatcccggtgctgtggcgaccgttccacgagatgaacgagacctggaactggtggggcggacggccgggcgcgaacggcggcgccaagatctaccagcagatgcacgagtacttcgacagccagggcctggacaacctgatctacgtgtggaacgtgcaggacaatccgacggccaactgggctcagtactatcccggcagcaactatgccgatgtggtgtccctcgacgcctggtacaagaattatccatcggcggccgactacgcgcagatccagtcgatcgcgggtacgaagccgatcgcgatcgccgagatgggcaaggtgcccaccgcggccttcctgaccagccagcccaagtgggcctacttcatgatctggtccgagcagctactgggcagtaataccaccgccgagatccagagcgcctacgcgaacgcccgcgtcctcaaccgcggccagatcaccatcggatccggtggcggcaccgccgccccggccaccaccgccccgaacaccgcgcctgcggccgcgggcgccaccggcaagatccgcggcgtgcccagcaaaaagtgcgtcgatgtcactgcggccggcaccgcgaacggcaccgccgtgcagctctacacctgcgacaccggcggaagcgcccaggcgtggacccgggccgccgacggcaccgtgcgggctctcggcaaatgcctcgatatcaccggcggtgtcaacgccgacgggacccggctgcagatctgggactgcaccgcaaacaatcccaaccagcaatggcggtacaacgccaccgcgcagaccttggtgaacccggcgaccggaaagtgtgccgacgccgtcgcggaagccatcgccaacgggacccggctgcagatctggacctgcaacggcaaggccaaccaacgctgggccatgagctagacaacggcccaggagatcctgcccggggcgggatcgacgcggtaaccgagcgtcgatgccgccccggacctgttcgccggcgccagtcgccgatcctcaggtccgcccgtgcccaaccgatgagaaagcatcgtcagccgtgccgggttcgaggagaacgaatgatcgcgacaagcctggccatgatgaggcatcgctggtcgcggtcgggcctgcttcccaaagtccgcggcctgttcctgatcaatctgctggtcagcgtggtgaccaccgtgcagcaactcgccttcgtcagcaccaccaacggattgatccgtacggcatccggcatgagcatgctctggctgggcgcctcggccgtgtacggctggcgccggcagcggctgtccgccgtcaccgagccactcgaatggctcgtggtgttgttcgcgggcatcgccatcggccgcgtcaatccggcgcttgcctcgttctacgccgtgctggtgttccgtccgctgtacggcacccggtccagcgcggtgactcgcccgctgatggcggtcgccgtgctggcgatgctgccggtcgtcgtcgccgcgacgggtggcgtgagcgagctggacacgctggtccagatccccggcgtcgtcatcatcgctaccgtcaccttcctgctgggcaacgcgctcgccggtcagcagcgtgccgaagcccggcagcaggcgctgatccgtaccggaacggccctgaacgccctggacaagcgtgagtccgtccatgccgaggcggtagcggccggactcgccctgctcggcgacagccctggctactgcgcgatcgtcgtgtgccacgacgggacaccgcgggtcgcggcattccagggcaccacccgggaatcccttcccggcacctccgtcctgtcgtccgacgacaccctgcgggcggctttcgccgatcagcctgactccgcgaccgatcagcgggtcggctcggtgaacgacgagctgctgctgccactgcacggtaaacgcgggatcagcggcctgctcgtggtgggcgcggcgcgcggcgtccgcaaggaggctcgcgccgacctgagcacgctcgtcaaccaggtcgtctccagcctcgacgcggcgcaactcaccgccgaactggtgcagcgagccagctatgacgcgctgaccggactggcgaatcgcgccctgctgcacagccggctcgacgcggccgtcgccgcgaccggcccggaccgccctcaggccgccgtgctgctcatcgacatggatggcttcaaacaggtcaacgacacgctcggccaccatgtcggcgacggcttgctgatcggggtcggtgaccggctgcgccgcgtcgtccgggacgtcgacaccgcggggcgactcggcggtgacgagttcgcggtcgtccttgctggtgtcaccggcgctgaggaggctgtcgcggtcgcggagcgcctgctgcacaccctcgatgagccgttcgaggtggccggccacctcgtggtggcccgcatgagtatcggtatcgcgctggccggcggctcgcgccaggtcgacggcgcggatttgttgcgcgacgccgatgccgcgatgtacacggcgaagcgccgtcagaccagcagctggcaactggctgacgagcggagcccgcacgccgcgttgacctgagaaggatccgcgggcgccggggacgacgggacagcgccgacgtctcccgccgggtggatgcccggccgggctcaggcgtcgttcgtggcgggcaggccggcggtgtgcccgggcgcgatcgacgcctgcacgaccagcgccgccgcgccgatgccggccgcatcgcggggctgcgccgacaactcgacgacgacctcgtggcggtgccgggcatgggcggtgcgggccagcgtttcccgcaaccgccgggcgtagatcgaaccggcgatcgccatgcccggcccggtcagcacgacccggcccaggtcgagcagattgaccatggaggtgaccgccacgctcaggtagccggccgcctggtccaccacagcgaacgcatcggggtcgccgctgacggcggcgcgcgcgatcgcgtcgtacgcaccgaagacgctctgttgctccagcgccaggccggcggcacgggccgcgtccacggtcgccaccatcgacgcatagcgctcaacacagccacggttgccgcacgggcagggcagcccgtcgtacgcaatcgacatgtgtccgagctcgccggcatcgaagctcgcgccgcggtgcagagcgccgccgaagaccaggccggcgccgatcccggacgacaggtagacgctgccgaacgcctgctctcgcgacacccgccggctccagaactcgcccagcgccgcggccgccgcatcgttctccaccagcaccggtataccgagccgctcagccagaacggcgcgcacctcggtccacggcgggacggtggcctcgtcgccgggacggacggcaggcgtcacgatcgccaggccctcgatccggtcacgggccaggtccagatcggccatgaagtcgtcgaaccgctcggtcagctgctccggcaggtccgcaccgtcgaacggaaccacctcgcggcccaccaccccgccggtcagatcgatggccacacacgtcagcgtgtccggtccaagttgaaagccgatcccgaaccggctggctgcggtgatcgccagcagtctgcgaggcttgccgcgcgccgaatcggccgagccggtctcgtgaatgacaccgtccccgatcaggtcgcgcactatgttggagatcgacggctgggtgagaccggttcgctccgccaactccacccggctgatcgacaccgccgaccggaccacgtccacgatcagcgcgcggctgcccggcccggcaacggaggtttctcgacgtgccatgacgtaaggattctccgtttcgcgtgccaccggttgtcaggcgataccgtacctgtcggcgaaacgagtgcggaggaatcggtgacgcaggcacaacggcgggtcggactggttctcgcacgagcctcccgggtgctcggcgaggaaccctactaccacgaattcatcgagggactggagcgcgtcctcacccccgccggcgtctccgtgctggtcaaggtcgtcactggtcggccggcagagaacgacacctacgaccgctgggccgagcggggccgggtcgacggcgtcatcctggtcgacctcgcgcccgacgacgagcgggtcacgctggtacggcggctgaacctgcccgcggtggtgctcggcgacccgtcgaccgcatccgggatgtcgacggtgtggactgacgacgccggctacgcccgcgaggtggtccgcttcctcgccgagggcgggcaccgggtgatcgggcacatcagcgggccgctcatcttcgcccacagccagctgcgccggcagggggcgcaggccgaggccgcggagttgggcgtcacactggcacaggccgacggcgactattcgtacgagtcgggccgcgccgcgatcgccgaactcctcgccgggaagcccaccgcggtgttctgcgacaacgacctgatggctctggccgtgctcgacgcgcttcgggaacgcgagatcgccgttcccgcggacatgtcagtggtcgcttgggacgactccgcgctgtgccagctcgccactccagccctgtccgcgatgagccacgacgtcgtccgggtcggcgaaatcgccgcaaacgccatgctcgacgcgatcaccggcaaaccaccgacggtctaccaggtgccgtacgcccacatcgtggtgcgcgacagcacgaactgagccggctctcgacgcctcatcacgctctcctgggtcgaagcgaacctgacccaccccgatcgcctgctcccggtagccgatcaactcgtcgacgttgtcaacgtcctggaagacggagtcagcgtccaggatcagcagcacgatcgcgccttcagggtgggcgccgacccagtagcgggtgacgaagacatggccttcgccctcgtcggcgtccgcaccgtcgagctgctccaggaggcggtccagcagcgatccgacgccttcggtttgcagcgggtcgaggtgtgttgcttccggggcgggttcagccccttctgcggcggcgctcgcgccgtagtggcgcggcatgtcggccgacgaccagccgagtaggagcatcaggtcaccggtgttgccgccggcccggtgccactcgtgggcatagttgtgccgccaccggtgcgcgtgcacatgcgctggtcgatgcgacagcgttcctgatcccccggaacaagggggcgtcggggtcggacaaaaggcttacgtccgcgggctgatgtccgggcgatctcagctccctacgatcgggccatgactcgctgggcctacagggcgctggacggggccgtgatcgtcgcgtaccccctcctcatggtcgtcgccgtccgaagcgtgcaggtcaacgacgacggattgcgcgtgctctggccggcggtcgtcaccctgctgcccgccgtcctggtcggacgccggccggtgaccgcgctgctgctcatcctggtcggcacggtgttcggattcacggtgatcggggccggcgactcggctttcgggctgcggctcatcaccgcgttcggcgtcggggcggtggcggccgcacgccgcacccgggtgggcgtcgctgccgcggccgtggcatgggtcgctctggtcggtggcgagatgtccgggtggatgatcgccaccggcgaaccggtcatggaacgggtccaggacgcactcagcgccgcactgctcaccttcgacgcgctgctggtggccgtcggactgaccgtcgggctgctgctgcggcagcgacgcgaacatgccggggcgatccgggcgcgggccgccgagcaggccatcaccgaggagcggctgcggatcgccagggagctgcacgactcggtggcccaccgggtcggggtgatcgcgctgcaggcgggcgccgccaaccgggtgttcgagacacagccggcgcgggcccggcaggcgatcggggtggtggagaattccagccgggaggccctggccgagctgcgccggatggtgggcggtctgcggtccgcggacggtgcgatgccgggcgccgggctcgccggcctgcccgacctggtcgccgccaccgccgaggcgggcgtgcaggtggaggtgctgtggctgccgaccgacctgccggccgacatcgaccggtcggcgttccggatcgtccaggaggcggtgaccaacgtggtgcggcacgccggggtgcaggcctgccgggtcaccatcgagcaggatgcggagatgctgaccatcgaggtgaccgacgagggccgcggcgggaccggcgtgcccgggcacgggctggccgggatgcgggaacgggtgtcgctgctgcacggcgagttcgaggccgggccgcgtccggagggcggtttccgggtcttcgcccggctgccggtggcggcatgacggtccgggtcctgctcgtcgacgaccagccgctgatccgggcggccctgcagatggtgatcagcgaggcgcccgacctggaggtcgtcggcgaggccggcaacggcggcgaggcggtccggctggcggccgaactccgtcccgacctcgtcgtcatggacctgcggatgcccggcatggacggcatcgaggcgacccgccggatcgccgggcagacccgggtgctggtgctgaccaccttcgacgacgacgagaacgtgcaccgcgccctgcgcgccggggccagcggcttcctggtcaaggacatggcgctggacgacatcctggacgcggtgcgggtggtcgcggccggcgacgcgctgctcgcccccggcgtcacccgccgcctgctgcaggagttcgcccgccgcccggccgtcgcggcgccccgcgccccggagggtctgaccgaccgcgaggtggaggtgctggcggaggtgggccggggacgctccaacccggagatcgccgccgacctgcacatcacggtggcgacggtgaagacctacgtctcccggctgctggccaagctgggcgcccgtgaccgcatccagctggtcatcatcgcctacgacgccggcctggtcaccgcccgcgacgccgcctgacccggaccgccgtcgcccgacccgcggcatgccgcgaaacgaccgttcgaggcaggctgcggccggttcagggcgcggagtccgattcgtttcgcgccggatcgtggatggtgttcatgtttgccggccgggaggatcttggcatggacgtagccatcttgcagcggatccgccagggcctgatcggcgccggcgtgattctcgacgggccgtacgggccgcggcgtaccacgcatgcggactacacggcctccggccaggcgctcgatttcatcgaggatttcatccggttccgggtgctgccgaaatacgcgaacacccacaccgaggcgtcggcgaccggcgcgcagaccgggtgtctacgggaggaggcccgggcgctggtgcaccgcagcgtcggcggcgggccggacgacgtggtgctcttctgcggatcgggggcgaccgcggcggtcaacaaactcgtcggactgctcggcctgcgcattccggagaacctcgatgaggtgtacgggctgtcgccgctgatcccgcgggccgagcggccggtggtgttcgtcgggccgtacgagcaccattccaacgagctgccgtggcgcgagtcgatcgccgaggtggtgccgatcggcgccgacgcgaccgggcacgtcgacctcgcccagctgcgggcggccctggaacgccacgccgaccgcccgctgcggatcggcagtttctcggcggcgtcgaacgtgaccggcatcctgaccgacgtgtccgcggtgtccgccctgctgcacgagcacggcgcgctggcggtgtgggattacgcggcggccgggccgtacgtgccgatcagcatggccgacaaggacgcggtgttcctgtcgccgcacaagttcgccggcggcccgcagaccccgggcgtgctggtggtccggcggcagctgatgacgaaccgggtgccggtcgtgcccggtggcgggaccgtcgcgttcgtcgacccgaccggccacaagtatctcgacgacccggtcgcccgggaggagggcggcaccccggcgatcgtcgagtcgatccgggccggtctggtcttcaaactcaaggacgaggtgggtgccgaggtgatcggtgcccgggagcacgagctgtggcagcggctgctgcggcgctgggccggcgtgcccggcatcgagatcctcggcgatctgcgcgccgaccggctgccgatcgtgtcgttccagatccgggccggcgaccgctacctgcaccacaacttcgtggtggcgctgctcaacgacctgttcggcatccaggtccggggtggctgctcgtgcgccggcccgtacgggcaccgcctgctcggcatcgacgacgcgcactcgcgggagttccagaccgagatcgcggccggctgggagggcatcaaaccgggctgggcccggctgaacctgggctacttcatctcggacgcggtcgccgactatctgatggaagcggtcgccctgatcgccacccacggcgaccggatgctcgccgactaccgcttcgacccgcgtaccgccaaatggtcgcatgtgaatgcggcgcagccgcgggtgcatctgagtgacctgcggctgggcgacgagatcccgggtccggcgccgactctcggcgaggaggtgctgccgtcgcacctggcgcaggcccggtccctgatggagtcccgcccggcggccgtcgacggcgacgggcacggcctgccgcccagcttcgagaagctgcgctggttcctgctgcccgcggcatgcctggcacagcactgagctcggccggccggatcccgctgttccgggggatccggccggagccgacggatcagtgcgggtaggcaggtcgctgagcggatcgcgccaccggcgggcacaatcgggcgatggatctactgctgctgcacgggctgggtgcgaccggcgaggtctggtcggggtgggatccggtgctgcgggatcggtggcccggccgctggcaagccccggacctgcccggccacggtgccgcggcggagttggacgagtacacgttcgacgcgctcgccgaggcgctgctcccgctcgtcgacccggccggacagaccgtggtgctgggacattcgctgggcggggtggtcgcgctggcgctggccgcccgggtgccggtggccgcggtcgtcgggctgggcatcaaggtggagtggaccgacgaggaactcgcccgggcccgggggctggccgggcggccggtcgcctggttcgacacccgggaggaggcgctcgcccggcacctgcgggtgtccggcctggccgggctggtcgccgacgatccgggcgggatccgtgccgacggcggccggtggcgcccggccctggatccgcgtgccttcggcgtcggcgcgcccgacatggccgggttgctcagccgctcctccgggccggtcctgctggcccgcggcgagcacgatccgatgagcaccggcgagcagctggccaagctgggcgtgccggtggcgacactgcccgggctgggccacaacgcccacgtggagaaccccgcacaatgcttcagcctgctggcggcgtaccactgaatcggccggtcaggcccaccgctgatcggcgacccggggcgccgccaccccggcctcccgcagagccgcgaacgcccgggtgacctcgtccggcacgtcgacgtgggcgatgaacccgcgcccggccgggccgtattcggcgaaccgcgggatctcccccatcagcagcgcgacgtaccggtccaccggccacatcccggccggcggcgaccggaacccgaactcaccgtcgatcaggtcgaccgtcgtccggtgcgcggcgaagttcacgatctgcgcgccgggcgcgtgccggcggaacccggcgtccatccgccgctgcatcgacgcgtcctggacgagcaggatccgccggtgcgggacaccgcgggcggccagcagtgccagcgcgttgcgcacgttgctgccgcaattggtcgactcgtgctccaacaggtcggcgtgaacgccgtaccgccgccggagataacgatcgaacaggccggcctcgctcagcgccggcacgtcatccccacccaggtgggagcgcatcgccgcgcgcagcacgtcggaggagtggccctccccgccgacgatcatgaaatggtcggcgacccggtcggtgatcgctcgcgcgaacaggtcgccgccggcgaggatgctgccaccgaacaggatcgcgacatccaccggcccgagcgcctcgcggctgagcacaccgacatcgcgcaccgcgcagaagtcggcgagggtggtgaggtgcgcgacgtcgcgcgggctcggcatcagcccagtgtgcccctcccgcatccgcccggggcgccggccgcgccgccacgtacctcaggcgttctccgggtcggcgagaatgacgccatgcccaccatcgagaccgcccggctcaccctgcgcgagtggcgcgacgaggacctcgacccgctcgccgcgatgaacgccgacccggaggtgatgcgctacatcctcgacggcgaggtccgcgaccgtgaccagagcgccgcgggcctgcagaagatgatccgcgactggcggcagcagggtttcggcctgttcgccgtccaggtccgggacaccggcgcgctgatcggctgggccgggctcgccgtgccgaccttcctccccgaggtcctgcccgcggtcgagatcggctggcggctgtcccgcgccgcgtgggggcacggcttcgccaccgaggccgccaccgccgccctgcggttcggcttcgacacgatcggcctggaccggctgatcagcatccgccacgtcgagaacgtccgctccgctcgggtgatggccaagctcggcctgctccaggagttcgagacggtcatcccgggcttcgaccaaccggtcgcggtccacgcccggtccgctgtgccgcgcctgggatgagcgccgtgctgtcccccttcccggcccaggttggtgccggagcagacgacgggctgccccggctgctcgtcgggcagcccgagcgctgggccaccatcgccgacaccgtcaacggcgtcgaccgggccggacgcggtgagcgggtgccgaccgtcgctgaaggggcggccatcgccagccccgtacggctgccggaggccgtcgaggccctgcgtcgctgtggcggcgcggcagtcgccgttgccgaggaacagattcacggtgcggtccgcgccttggctacccgcggcctgtacgccgaaccgaccagtgccgtcgcggcggccgcactcgaccacttcatcgctgacggcaccatcactcctgatcagacgactgtggtcgtgctcaccggctcggggctgaagtcggccgacaagaggtaaagtgcacgggcatcgaccaggatgacgggggaacatctatggccatggcacgcaggctgttcttgggaagcttcaccgccggggcggtaacggtcgcactgggtgagtccaccccagccgctgccgagacgaccaccacgacgtttccgggaccggtggtcgcgcaacgcttcagcacggactcgacgatcgagtctgcatatttcaagaccacgtcggtgaccgacaacgcggtgaccgtctatcaggccgccgcctcgggcagaggcgtggcgttgaacgtcgtctccgacaatcccgagaactcggccatgtatctggagggcacggagaccggccgcgggacgctcaagatcacccatcagggctacgacgacggctcggatcgcagcgccgccgcgctctcgatcgacctgcggacggcggggaccgccgcgcagggcatctacctgacggcgacgaacgggccgacgacgggcagcctgatcgcactgcgcaacaaccccggccgggatgacttcatcgtcaccggtgccggacggatcggtatcggggtcaaccggggtgacacaccgcgcggacaggtgcacatcgtccagcagccgggagtccccgcaggagtgttgatcgagggcgtggtgcggatcgccaacaccgccaccgtgcccacctctgccgactcgtccggtgggggaaatctgtatgcggtgaacggggcgctgatgtggcggagtgccaacggcaaggtcacgcagatcgcctcggcttgagcggtcccgaggcggatctcggcttaagcggtcccgaggcggatctcggcttgagcggtcccgaggcggatagagaagaggtcaggcgcgaatgcagttgacggcagatgagctggtatccgaattccacgatgcggtgatggagctgtacttcgcgcgaaagcgcatcgtggccctagaggcggagatcctggccttgagagcgcaactcgacaccggcgaacgcgagtgcaccgctgatgccgctgaggcgtcgacgacgccacaggaatccgcgagccgctgacttcgcggacgcgtaggggaggtgcggctggccggtccggccgacctcagccgcgcaggacccgggtcagggcggtgaacgcggccttgggcgccaggttccggtcgaagatcaggtcgtcaccgagctggggtggataggtgccggactcggtggtggacccgtaccggtcgctgaccccccaggtggtgtacgaggtgcagttcggggcggccaggcaggcggtcaacgcggtggcgtactgctcagcctgcccggccgcggcatcgccgtacacatcgatctcggacacccgggccgacagcccgagccgggccaggtccgcgaagtgatcctgcaggacggccgcggtgacccggtcgccggcctcgtggatgtgtgcctcgaacccgaccccgtcgaccggcaccccccgctgtttgagccggccgaccagactgagcagcgcgtcccagcgctcaccgtcggcttccaggccgaaatcgttgagatacagcttggcgccggggtcggcgctccgggccgccacgaacgccttgtcgatgtacgtctcccccatcgcctgctgccacaggtgccggcgcagccccgctcccccgtcctcatagtcctcgccgtcgggggacagcggttcgttgacgacgtcccattcggccacccggccgcggtagtgaccgaccacggtgctgatgtgatcgagcatgatccgctcgcgccggtcggccggggtgtcctgcatccagcgcgggttggcctcgccgaagaccagggtgtgagcgtgtaccgcgatgccgttggccgccgcgaagtcgaccagcaggtcgcccccggtgaagtcgtagcggtccggctgcgggtggacgaactgcggcttcatcgcgttctccgtggtcagcatggagaactgggcggcggtcaagcgccggtacccgtcgtcggccagcagcggctcggcggccactgcggcgccgatgggcagcgcccggcgggccgcggcgagcacccgcagcgacccgggctcgggcgccggttgcccgagcgccggggcgtcgacgacggtgacgctgcccccgtccagcccggcggcccgcaacgaggtcaacgtccagccggccggcccgccgccatcgacgtcggcgccgaagaacacccgcccggaactgaacaccccagggtcggtgacggacagaccggcgtccccgagccggaccgtgagccgcccacccgcccgggtgacggttatcgtggccgcgcccggtgcggtcaccgtggtccggcggcggaccgccggatcgtcgccccgcccgtcccagaccgccaggcgcagctccccgtcggtgacggtgacggccagaccgggcgggttgtgccgccactcgtcgtagaccaccggcacatcgccgtacaggctgaacacggccgcccggccggccgggcgatccaccccggcgatgatctccatcgggccgcgcaccgcgagccgcggcccccgcagattgaccggcgggtcgggttggccgccggagccgtcctgccgcacgatccgctcgcccaggccgacgatccgcaccccgccggggccgacggtggccccggcgaaatgcgtccagtcgtggccggtgaggacatcgacggcggtatcgtcatcgagcgttgcgtcgtcgccggcgctgaccgccacccacccgccggccacgaccgccacgaccgcgaccgccagccaggcccgagggtgcatccgcatgcctgttcccaccaatcagaagtgagctcgacgcgaacggtgagaccgttgccggtgcggcgttcctgcagcggttcacggaccgcggtgaagacctcccgggggcgcgtccgttgaacgccccaagggtgctgggctcagctctgcacggtgatgtgctggtgaccttccacaacggcctgctggtcagcctgcacggtgatgtgctggtgaccctccacgacggcctgctggtcagcctgcacggtgatgtgctggtgaccggcaggtgcggatgcgaccgcgccgatggtggcggctgccgccagcaacacggccgtcaggcggaacttcgacatgtcttctccttggtcggggaccgccacgaggcgggacgctgatcgtagtcattccaagctcggtggcagccgtcccgcccgccgcagcgtcaagccggacaagggctactgccggctcgactcggtccgggacttctggttcgggttcccgtcgatgctgctgttgttcaccgtcgcccgcggtcgctgagcactgcgggcgcgacgccggtggcgatccaccgggccagcaccggccggtccaccagcgtgatccggcactgccgggcaacctggagggccggcccggtcgggcgcccggtggtgaccagcagcgcgacgtccgcgccgtgaatgtcgcgggcggtgccggcgaagcgctgcacgtccggactgggcaggttcccggcgtagcgcttgcactgcaccaccaggcgccgaccatccggcgtccgggcggtgatgtcggcgcccatgtcccccgcgccgccgctgacccgcacgccgcggcagtcgctctcgcggagcagccgcgccacgtactgctcgaactccgggccgctcatgtggtcggtcaccgccacgtcgcgctcgtgggccgcgagccgactcatcgccgaccagctcagatacgcccacgccccgccaccggccagcaccagtgcggtcaccaccgcggtcaccaccgcggtcaggaccaggtgctcgcggaccacctgggccagcaacccgacagccaggagaccaccggccgccgcggccagcgcagcaccgtcgctgatcctgcttcttctacggcgcctacgtcgagccaccccagaccccctgccccactgttcgcataccgatgcatacgcaatgtagtgaacgggtgcgacagaaagacatcgccgcgtgcccgctttcgtcaggttccattaaccgcccgtgacacttggcatgccgtacgtcaacgggatcaggcaattcggcccagagcggctcgaagtcgaaatcaccaggattctctgaccagcgcacctcgaaagatcagcagttccaccacttccggaggacttgaccacggtgtcaccgccgagtttttttgacggtttccagacccttggaacagcacgttgaacagggaagatgccgcgtgtcgcggtcggtttcaggtaaccggttcaaagaacgtgttgaaccgctgcggcgctcggctccgtacaggttcacgttcggcacatcgacgcctcaaggagtgatgatgagaacgcgctcataccaacggaacctgggcaacggcacgcggcgaaaggtggccggcgtggtcattgtcgggggcgtccttgcggcggccggtttggcgggagtgcaactcgcgtcggccagcaccaccccgccaccgcccaaagcagccgcgaacgcgcagcaggcgcagggcggcaatgacgcgacactggcgtcggcgcaggcgctggagacggcttgtgacaccttcgcggcagatgccgccggggctaacggccagaacgccggcaaccagggtgccgacaatcagaatggcgacaacgcccagaacgaccagaacgcgggtgaccagggcgcggccggtggtaaggcggccggcaaggatggcgccaaggcgggtgccgcggccggcaaggcggcatccgacgcccggaacaagaagatcgcgaagaagtgggcgaaggcgatggccgaagccaacaagaagcgtggcaagtccggcaagaagggcggcaagtacggccagaacgggaatgcgaaccagaacgggaatgcgaaccagaacggcaacgccaaccagaacggcaacgccaaccaaggcgccgcgaacgccgcggtgacttcggctcaggcatcgcttctgcaggcgtgcctggcgctggccgacgccaaggctgtggccggcatctccaacaacaacggcaacggcaacaacggcgaccagaccgccgacccgtccgccagcgccactgccgacccgtccgccagcgccggcgccgacccggctgagtccgactccacggccgccaactaagaccgatccttcggcaccgaccacggatccggggaacgatcacaaccggcgtcgccgggcgcgggcacgcactcggcgacgcaaggccttcccgtcgatctgatccggaacggacagtacgaccgacggccggcaccgggatcactccggtgccggccgtttccgcgctgtcgctgtacgcgaacgtccaggccacacgcacctcaacgccaaccggaccttcagccacatcagcggcctgcccatcacaggaacggcacgaaggctcgtcgaactggttgaacgggaggatcaggccacacagaactcgttgccggacgggtcctgcagggtgacccagtgcttgccgtactcctggtgttcggactggacggtcgcgcccagctcggccaggcgtttcacctcaagctcccggtcgtcggcgttcagatcgaggtggcagcggtttttcgcggccttgtcgtcgggcaccttgaggaacatcagggtcggcccgggctccgcggcgccgatcgtcgcgaagaacgggttggcgccggggtcgaccggccgccgcagggcctgcgcccagaagccggccagcgcggtggcgtcggcacagtcgaaggtgatgttggcgagggcgagcacgggtgtcacttcctaacgggaaacgggccagcagatttcggtgcggaactcttcctcggggacgccgtcccctggtccgaccaggtagctttcgcggaccgggccggtgatcgcgaggccggtgcgggccagccaggcgccgagcgcccggtaaccctccgacatgttgtagtaggggccgacgaactcggcgaccgcgaaccggccgcccggtagggtcgtgtcaccgttcgccgcgggcacgtaggcgatgatcgggctgggctcgtcgcggaactccggtgggaagatcgcgccacacgggccggtggcgatcgcgcgcgcggtgagctccgcatacgcctccccgaggaagtcggcgaactggtcctcacgggcgtcacgggtgagggtgaacgcggtgatcggcggcagggtccgggcggtcacctcggccggggtgatcgccaccgggtcgtcgagcaggtcgccggtgatccgcagcatccgctccaggcgggcctgccggtccagcagccgccgccgctgtgcggccagcacccggcgggtcacctccgggtcgcgggcggccaggatgacccggatgtcggccagtggcaggtccagctcgcgcagctgccggatcgtcgcggcgtcgccgagctgcgcgatccggtatccgcgatagccggtgcgctgatcgaccacggccggctccagcagcccgttctcgtgataggcccgcagcgtgttggccgagatcagggtggcacgggagaacgcgccgatcggtagtaggtcgtccaccgcctcagtctcaaccttggcccagggtgaaggtcaaccgccggataattcgctgtcgccgcctgtccggggactggtagacctcggggatgaccgagaaggctctacccggcgggaacatcaccggcgccgtgctgatcgacggcgtggtgcacaagccggcctcgccgtggacaccgaccgtgcacgcgttcctgcgtcatctggaggcggccggcttcgacgccgcgccgcgcgccctcggcttcgacgagcggggccgggagatgctcagctacctgcccggcgagacgatcggcggccgtgtgccctggccggcgtgggtgtcgtcggacgcgatgctggtccaggtcggccgctggctgcgccgggtccacgacctgaccgccggcttcgtgccacccgagggcgagcggtggttcgtcggcggcgagctgcggcccgggctggtcgtcggtcatcaggacgcgtcaccgttgaacgcggtcgtcgacggcgaccggctggccggcttctgcgactgggacatcgcgagcccgtccgtcccggagtgggatgtggcgttctccgcgctgacctgggtgccgctcgccgccccgcaggacggcaccccgctgaccgaggatgaccggcgggaccgagcccgccgattccacctgctgctcgacgcgtacggctatgccgaggaccgtcgtgccttcgcgaccgcggtgccgcagcgggcccgcaagcaggccgccgtcatccgtcaccaggccgcgtccggcgacccggcatcgaccgcgctgctgcccatcgccgacctgttggaccgctccgcggccgacgtcgatgcgctcccggagggcttctggatcaaggaccggatttaggcggatccgttagtcgaggcagaactcgttgccctcgatgtcctgcatgaccaggcacgactcgttctcgccgtcggcgagcaggagccggaaccgcttggcgccgagcggttcgagccgggcgcactcggcttcgagggcggcgaggcgctcgtcgccgaccaggccggtgcccacccggacgcacaggtgcacccggttcttcaccactttgccctcggggacgcgctggaagtacagccgcgggccgaccccgttcgggtcgctgcaggagaagccggcgttgcgtttctccgccggccggctcgcgttgtagtcatcccagctggcgaagccggccggcggagccggtgggacgtagcccagcacctcgcaccagaaacgggcgacccgctccgggtctgcacagtcgaaagtcacctgaaactgtttgaccgacgccatggatcaaccatagcgccggtcatgacacagtggatcaggaaacgtcgccgcgccatccgccggtggcggtgccccgctcctcgatgaactgcttgaaccgcttggcgtccgccttcacctggtggctgtcgacgccgaccgcgctgccgaccttctcgacgaagccttccggctcccagtcgagctggatggtcacccgggtctcggtgtcgctcagccggtggaaggtgacgacgccggcgtgcttggtgtcaccgccggtgctgtgccaggcgacccgctcgtcggggtgctgctcggaaatctccgcgtcgaactcgcggatctgaccgcccaccttggtcacccagtgggtgtgggtggcgtcggtctgggtgatcgattcgacgccgtccatgaacttcgggaagtcctcgaactgcgtccactggttgtacgccgtgctgacgggcacgttgacgtcaacggactcggtcaccgtagtcacgatgttctccttcgctcgggatgatcgggaactacccgtccccgatcgccccaaacaccctgcgtcgatttgcgcgtcgaaatttttcccgttgacgacgggcagacgggtcacctgtcgagcaggcgcctaagcgcgcgccgtgacgccggcaggggacggccggcgtcgaactccaacgcggagatctcccgcaccatcgcgaccagcagctgagccgtggcttcgacgtcctcccaacccatcgcctcgaggtcggcgaacccgccttcggcgaggcgctcgcgccgtgcggtcatcgcgccctgctcggggccggagcgcacctcgagcgagagggccttggccccccggttctgcagggagatgtcgagatagacctcgaaggcgcgaaggagccgctcggctcccctgggcaaccccgccacggcagccgccatgccggcctcgacgcgggcgtggaagcgggcgtgcagggcgtcgacgaacgcggaccggtccttgaaatgcacgtagaaggtgcccttggcgacgcccgcctccgccaccaccatgttcacgctgacgccgctcagcccgtgccgctccgccagcgcggcgccggcatccagcagcgcctcgcgggtctgcggagctcccgacatgggcaggtcctgtgtcacgtcgagagtttagaccggacgatgggtgaccgaccggtcggtcaccgtgttacggtccatgccatgcccctcctcgacaccgcgaccggccggatcgcctacgacgcgcgcgggtccggtccggccgtcgtcctgctgcccagcggcgcccaccaccggcgcgactacgacgccttgcgggccctgctcccggaccgcttccgcagcatcggcatcgactggcccggccacggcgaatcccccgccggcagccgggcagcggatgaaccgcatctcgccgacctggtcgagcagatcctcgatcagctggctcccgacggcgcggtcctggtcggcaactcgatcggcggtaacgtggccgcgcggaccgccgcccggcgccccgccctcgtcaggggcctgatgctcgtcgacagtggcggcttcgagccaccccggctgcacagtcgcatgttctgcgcgctgatgggtcgcccctggttcgcgcgagcggtctatcccggcttctcccggtggtacatgcgctcccgcacgagcgccgaccggcgggcacgcaccgacgcgatcgccaccacccgcaccgccgcgggactgacagcggtcacgcagatgtggcacagcttcaccctgccggagcacgatctccgcgggctggccggacggatcaccgcgccgaccgtcgtggtctggggccggcacgacccggtgctacctctcgcggccgcccggaacgctcacgccctcatcccgggttcctcgctcgtcgtgatcgacagtgggcactccccgcacaccagcgacccggcatcggtggccgcgcacctcgtcccccttctcgacgcggcattccccgcgaaaggtccgagcaccacccgacagtaaggatccgcgcaccttcccggcagcgataccgagccggcatggcgatcaccctcatcccacggttcccggtggacgaccagagctcagcaccctgcacgcccgcgccttcaacgccgacccctcggccatccgcccgtggtcccggcgactctcccggcacgccctcacctggatcggcgccttcgacgacgaccggttgatcggtttccttcaggtctgctgggacagcggcagccacgccttcctcctggacaccgccgtcgacccggaccaccggagccagggcctcggcgccgccctggtgcgggccgccaccgccgaggcccgcgccgccggctgcgagtggctccacgtcgacttcgaaccccacctcgaacacttctacctggaccgctgcggcttccgcccgaccccggccggcctggtccacctcgcgtgatcggcaccccgaggcagtgtcagctgccgccgtcaggtgtcggtgtactcgatggagcggctctggcaagattttcgtggcgggagaccactagaacggggaattgaggcaagcgcggctttccggcgatcctgacgatatgtggtgttgagctctccgatctgctgccgcatctggctactgtcgttggcaccgcggtcgaaacgaccggtcctgtggtagtcgtccgggcccgcacccggatggaggaggcgtttgcctgtaccggctgcggcagggtgagtgatcgggtcgatagtcggtataaacgctggctggccgattcggcgatcggcggccgtccggcccagatcgagctgcaggctggcggaccccatcgatcatcaccgaggtagccgcgcctccgcttagcaggcggcgttgcgcagcggcccgcgcgttatctccggcaatggagtgcacttcgacccggcctacccagtgcgccgactttatgcgtcatccgagagcatcgccggacgctgtcgcccacgggctgtgctcgtcgcagaatcaggtaatgaacgcacctgatcgaaccgctttcaccaagcgcggcgcggcagtcaccgggctcgcggcctcggtggtcttcacgctcgctgttggcggctcccagcatgagtggaccaccggtttgatgaccggcactgcagtcggcacctttgtcttcgcctcccactggttcgcagcgcggccgcgctgctgatctggcagcggctggcagcacgtacgcccggacatcatcaggcccgggcgtcgagcgccttgtcggcggcatgagagcgcgtctcgatttgggcggtgcgtcatttgcctcgtgccggaccgggcgacgtcgagatggcacagaggccgattttattcgacaccatcgtgattctggattttgcgcagcggtagggctgggttggagtagtaagccaatcatccgcgaggttgggtatcagtctgacgctcggatcttctctgcagcgcctctgagtaaccccggtgccaggcggcggtggatggccgacagcgggggccagacgccatgtcccacacgctggtcgtagcgcacgaaggtccccagcgacacctgcccgtctgttgcttggacgatgaggttgcagctcagaaaccaggaagcagcctggagccggatccaatcttcgccgtgtccggtgatctgccagccggcaacggtgcccgtcgatcgtcctcgggtaagccgcagcccgagaaggccgcgccagattagttgggcgctcacgctcggagtgtcgccgaacatggcgcgggcccactgctcggctgtggccgcgacctgcgtggagagggtgaactgatcggcgtagtcgatggctgacaacgagctgagggcgcggacacgccctgagaccttgcgtgttccgaccgtgccgacgatcgaatctgaggtcatcgcatgcccccgatcttgtatacgatgccgtacatcacaaaggtaactccatctatacggtggcgtatagatggagtgaggtgttgggcgggacataccatgggcacgacacgcacacctcgcgacaggtggatcgaagcgggactgcaggcgctggccgtcggcggcccggatgccgtccgcatcgaggtcctggccaagaaactcggcgtcacgaaaggcgggttctacggcttcttcgccgatcgcgacgcgcttctgagcgcgatgctcgacgtctgggaacgcgagagcaccgacgaggtgatcgaccatgtcgagcaggaggagggcgaccccaagaccaaaatccagcaagcgggacgactcaccttctcccacgatcgcctactgcccatcgacctcgccatccgcgactgggcccgacgcgacgaggcagtcgcagcccgcctacggcgagtcgacaaccgccgtttcgcgttgcttcgcgagatgatcggtacgttctgctccgatgccgatgaggtcgaagcgcgcagcctgctcgccttctgcgtggcaatcggcgagcacttcctcgccgctgaccacggtagccgcacccgagcccaggtccgcgcccatgccgctgacttgatcctcaaccgccatacagccggcacgacgccgtctgacgcatcagcgagggttgacagaaagcctggtcacgagtgaatggctcgtcccgcatctccgtcctgagaaacggctgacgctgttctccaccgcaagccgcaggggcgccgaacgcactcacatcggccatgagcgtgcgccgctaccccaacagccgaacagacgaggcggtcacgcgccgctaccaaaggtactgggcagatctccatgtgaggccggctgaggccgcccctgctcggagccggtccggcttcgtcgtggcccgcgccgcgaccgactaatgatctcccgccacgaaaatcttgccagagtcgatggagcgcagagctgagtacgtctgatcttgcatagccggcctgactcgccgcgctgttcgcggcggatggatcatgtttgtcgtgacagcttcggatctgcatgagcggccctcgggtgacctgatcaagatctggttcaagttcgtgccgcgtgagggctggttgccgtatgacacagagggtctgtgggccactcagttgggcgaggacacggcccgggtggcaaacgtggcgttcctgcagaacggcatcgcgcaaggtgacgtggtgcgcttccagacgaatgaggatggtttccgctgggcgacggaccgggtggaggcgtcggggcactgcgtcatccggatcctgccggtaccgtcgggtccgctgggccggagtgcgtcggctgtccaggctgcgttcgcgcgtttcgggttgggcggggaggtgttcagcgccgagttgccgttcgtggccttcgacgttcctgccgatgccgatttcggtgagatccagcaggtgctcgcagatggcgagtcgcagggctggtggcacttcgaggtcggttgtgggaccgaccgctggtggagctcagcggcctcctgaaagagatcctctgcacgttcagccgtatacggctctgccctcttggtactgcaacggcactcggcggacggatcgacgatcggctcgttgaatggtgcgagacgagttcgaggttgatcagtgatcggatgagctggaccggttgcatgcccgtttcgctgaccggttcacacggccggaaaccgcagcggcaggcctgtcagtatctgtccggtctggtcgtcggcatcgatcgtaagagtggccggactctcgcggaccgagccggtgatctattgccggacgggatgcggaggctgttgcgatgggccgtttgcgacccgatgcaacgacgacgtggtcaccgtcgacacaggccgggccgcgtacgatgacggcgtgcctgagcgatcctgggaagtcgaacccggttccggagtcggtccgctgcggttcggcacctcgcgcggcgagttgcacgcgcttctggggccgcatcgggcgttccggcgcagtcccgcgtcggatctgacggatcagttcgaggcgggcgggctcatgctcacctgttccgaggacgagggtctccacctgatcgagatccccgacccggacggcgttcactaccggggtgtgcggctcagcggcacggtcacgacggtgctcgcggagctgcgggcagcgggcgtcgagctcaccgccgacgacagcggctggcttttcgccgacggcgcggtcgggctgtacacgccttcctcggagccggacgcccgggtcgaggcggtgacgatgttcggaccggggcacgagatgaccggcgaaatcgtcttcttcccggccgggtccgaggcgatgccgcccgtctcgtcctatgtcgtcacaccaggtacgggtgtcggccccatcaccctggggatgcaccgggacgaggtgcggcgccggctgaacggcggcctgtgcttccggaacgcggccggctcgcgggagccggagcaggacgaattcttcgaggatcacctgacggtccgctacggccccgatctgctcgccgtccacatctacgtgaaccgggcggacgccgtgctcctcgacggaatcaacctgatgccgacgcacccgctgaccatcgaggatgtgcgcccactactgatccgggcgggccgcacgctggccgagcgggaggccgggatcgatatcgtcggcaccggcgtcgagatgcggacgatgggcccgctgtcatccggctacggaccgcttccggtcgcctgtgtcgccgtcgccctgcagccctgaaccgacggcgccgccggagactccgtcgaaaagccgcccgagcagggccgactgcccggcggccagtacatgcccctgtgccagcgggagccagtagcactcgaaccgaaccggcgtgccgtcgccgtcgccgcgttcctcggtgaaccagcgctccgggacctccggcgcgtcgaccgtcaggtggaagaaatgccgcacgtggacggcatcggcgtacggccgcatgtcgaattcactcaccccgaggtatcgctcgacgcgcagccccggcaaaccggtctcctcggccgcctcgcgcaccacggccgcttcgggcaactccccggcgcgcacggtcccggcggggacctgcagcccggactgatcgaaactgacatcgtccacgtgcaggaagaccagaagccgaccctctcgaacgacgtaggcgactaccttctgcggtctcagcaccgacgcagcctacggcctcggcgccgtggtggcggggtttgggcactctgacgacatggagacttcagcccttgccacggtcatccccctcgtcggcgtcgcgttgggggcggtcagcaccttcttcgggcagtacatcgcgctccggggtcagcgccgcgaccggcaggaggagctgatcgccgcagccagagccgagactcggcgagcgatcctcagcttcctgtcggcggcgcaggatgtcgagcgggaggtgagtcggatgaagcgggggctcgccaggcgcgatgagatcgccgatgagctgatcggcgacctctggctggcgaagaagacactggagctcgtctcgagcccggagctgtcgcaatgcgcccatgactacacgtccgtgctggagtccctggtgtgggacagcgtctcctcctccgccgtccaggagaagcgcgagcggcgatggaggttcatggaagcggcacgacatgaggtcggcgccggcgtgcggtcgatcgatcgatggtcggtttccgagcggctgagcggcaaaccgctggcgccggggaacagctctccgacagcttcggtggaacgcgagggcgtccagccgtcgtgagctgatcacgagcgcaaccggcgcctgccggccgtaggatgcccgggatgacgaccttcctggttctcttgcgcggcatcaatgtcggcggcaagaacaaggttccgatggcggatctcaggacgcttctcggcgagtgcggttttctcgacgtctcgacgttcatcgccagtggaaacgtcatcctcacctcggaccgggacgccggccaggtggcggcccggatcgaggcggagctgcccgaagccttcccgctcgacagcgagctcgtcaaagtcctgaccctgaccggcgatcagctccgcgctgtcgtgcgggaccgcccagcgggtttcggcgaccgcccggacacctatcacagcgatgcgatcttcctgatcggcctcgaggccgccgaggtcatgcccatcttccatccgcgcgagggcgtcgaccgcgtctggcccggaaacggcgtcgtctatgcgcagcgtctcagcgcccagcgcaccaggagccggctgagttccatgatggcctcgcccctctatcggtcgatgaccattcgcagctggaagacgaccgtcacgctggcggagatgctggacgcgcggacagcgcgcccctgaactttgccggctcggctgcaggtggaccaccggcagccaggccgcgtggtccaccacgcagaaccccgcaccgccggacgcggcaggcctttcgcgtgtatacactcggggtataccctgagcgcatgagtgttcccttgaccctgctcgggctgctcgaacgggccccgagccacggctacgacctcaaacgcgactacgacacgtttttcggcgtcggcaagtccctgccgttcgggcaggtctacgcgacgctgagccgcctcacccgggacggcaaggtggtgatggacgaggtggcacccggtgacgggcccgagcgcaagcgctatgtgatcactgagcagggcgccaccgaggtcaactcctggctgtccgacccggtgaccccggagccgcacctgcagagcatcctgttcaccaaggtggtcctcgcgctgatgctggaccggccggccgaggcctatctggacgcgcagcgccaggcgcacctggtgcggatgcgggaactgaccgcggtgaagcgctccggcgacctggtggagacgatgctggccgaccacggcctgttccacctggaggccgacctgcgctggatcgacacgacgtcggcgcggctcgatgccctgcgtacgcagatcaaggcgggcaaaccgtgaccgccgcgctgaccgcgaccggcgtcgcgttgtcgttcggcgcgacgccggcgttgcgcggcgcgaatctggcggtggccgagggcgagatcgtggcgatcatggggccgagcggttccggcaagtcgacgctgctgcactgcctggccgggattctggtgcccgacgccggggagatcgatttcgagggggtacgtctcaacgggctgaccgaggcggcccgcagcgagttgcggcgcgaccggttcgggttcgtgttccagttcggtcagctggtgcccgagctgtccgccgtcgagaatgtcgcgctgcccctgctgctcggtggcgtcaagcgggatccggcgatccggcaggcccgggagtggttcggccggctcggcatcgaggggctgcagggccggcgctccggcgagctctccggtgggcaggcgcagcgggtggccctggcccggggcctggtcgcacggccgcgggtgctgttcgccgacgagccgaccggggcgctcgactcgctcaccggcgagcaggtgatggagctgatggtcacctcggctcgggagcaggggaccacggtggtcctggtgacccacgaggcgcgggtcgccgcgtacgccgaccggctcgtcatggtccgcgacggcaaggtcacctcgccgtcggaggtgcccgtctcgtgatcagtctcggactccgactggcggtggccggcggccgcgaggcgatcacccggctcgtcgtgctggccgcggcggtcgcgatgggtgtcggcatgctgctcgccacgatcgccgggatcaacgcggtgcacgcgcagaacatgcgctacccctggttgaacagcggcgtgaccagcgtcgcgaccggcccgcaagcgcccgacccggccatgtgggcgctgcgcgaggactacttccacgggcatccgctcgcccggatcgacgtggcggtctccggcccgcacggtcccaccccgccgggactggccgcgctgcccggccccggggagtatgacgtctcccccgccctggaccggctgctccgcgaccatcccgccgatgagctgcgcgaccggttcgcggggcggcaggtcggggtcctcggcgacgcggcgctgccctcccccgactcgctgatcgcggtcgtcggcggcacccgggaggaggtcggtcgcatcacgggggcgaccgagatctcccggatggtgacgatcgcaccggacaagtgcgacggttgcgtcgtgggcctcggcgaacggggcatcgtgctgaccctgtccgtggtcacggccgctctgctgttcccgttgttgattttcatcggtacggcgacccgcctgtccgccgcgcgccgcgagcagcggttcgccgcgatgcgcctgatcggggccacgccgcggcagatcacccagttcgccgtgctggagtccacggtggccgcggtgaccggcgcgatcgccggcttcggggtgttcttcgcggcccgcgccggcctggcgcagatcccgttcaccggtgagccgttcttccccggcgacctgtcgctgtcggtcaccgacgtgctcgcggtgctggtcggcgtcccgctggccgccgcactcgccgcccggatcgcgctgcgccgggtccggatctccccgctcggcgtcacccgccgggtcaccccgaaaccgccgcgcgcctggcggatcatcccggccctgctggccctggccgagctcggctatctggtcaaccaccgcccgaacaccacacagggccagacgatcggctatctgagcggcatcttcggggtgctgatcggcctgatgatcgccgggccgtggctgaccatggccggctcccggctgctggcccgccgcgcccggcggccggccacgctgatcgccgggcggcggctcgccgacgacccgcgggccgggttccgcgcggtcagcgggctgatgctggccctgttcgtgaccaccaccgccaccggggtgatcaccgcgatcgtcgccgagcgcggcggcggcccggtcggcgcgcgcggccacgacgtggtctggatggagctgggggcggaccgggagggcctgccgccgactcaggtacacgtacgggctcaacgggtccgggccaacccggacgcgaggccggacaacgatcatctgcccgggctgatcgcctgcgccgacctggcgaacatcccgggcagcggcacctgcccggccggggccgaggtggccgaggtcttcaccgacctgagcacctcgacctggctgccgcacaccgcggccggctcgacctggccggccgcccggcagaccacggcgcagctcggcgcactcaacgtgctgtccgcgctcatcccgaccgacggcagcccggccgccatcgagcgcgcccggacgacgctcgacaacgcgttcccggacgggcggggggccggcaccgaggccgacttccgcggcgacttcacccgccagctctcccagttcgagcggctggccgacgtcgtgatcatcgcgagtctggtgatcgccgggtgcagcctcgcggtcagcgtcaccggcggcctcaccgaacggcagcgtccgttcgcgatgctgcggctgaccggggtgcggctcgccgaactgcgccgcgtgatcgcgctggagacggcggtgccgctgctggccgtctcgatcgtcgcgatcggtgccggcttcacggccgcacacctgttcctgcgctcgcagatgcagtacgacctgcacgcgcccggcacggcgtactacgccatcgtgtctctggggttgctcgcctcgatcgcactgatctcgtcgaccatgccgctgctgcggcggatgaccggacccgccgcggcccgcaacgagtgatcagcgccgatgaatggcacgaaattcggcaccaacggctctggcggacggcagcgcggacgcctgtgctgaagtcgacgagaggaggtcacgacatggcaggcacgctgctcccgtggcccgagatcgagaagggcgccaaggaacacccggtaccgaccctgcagtacctgctgcgggcccgcgggcagacgatcgcggtcgacggcatcttcggcccggagaccgagaccgcggtgctcaccttccagcgggcgaacggactgtccgccgacggcatcgtcggcccgcacacctggagcgcgctgatcgtcgaggtgcggcgcggctccgagggggacgcggtccgcggcgtccaggaggagttccagtatcggaacctgtccggcatcccgggcaacggcctcgcggtcgacggcatcttcggcccgcggacagaggccgccgtccgggcgttccagaccgcggtccacgccgatgtaccgaccctgacggtggacggcatcgtcggcccgatgacctggcaggccctggtcagcggcatgtattcgttctgagcagcacggaccggccggggtcgtcgtcgcaccgcacagcgcgccgacctccccggccggcgcccttgtcggaccgcccggtctgacaggcggaccggccattctcagatccagccgtgcccgcgggcgatccggaccgcctcgtgccggttggcggcgccggtcttgccgaccgcggccgacaggtagttgcggacggtgccgggtgacagtgccgcccgccgggcgatctcctcgaccgccgccccgtcggcggccagctccagcacgtcggcctcgcgcggggtcagcgggttgtcgcccgcgctgatcgcctcggcagccagctgcgggtcgacgtagcggccgccgccgtgcacggtacgcaccacgcccgccagggtctccgcggagacggtcttgggcaggaacccgcgcaccccggcggcgagggcgcgcttgagatgcccgggcagaccgtggctcgtgacgatcatcgtgtggcaccccggcagctcgtcgtgcagtgcccgcgcgaccgccaccccgtcgaggtcgggcagctgcaggtcgagcacggccacgtcggggcgcagggcgcgggccatcgacaacgcctcggcaccggtcgcggcctgggccacgacggtaaggtcgtcctccagcccgagcagcgccgcgagcgcgccgcggatgaggtgctcgtcgtcggcgagcaggatccggatcggcgtcacgcggtggcctcctccgccgccatcggcagctgcgcggtgagccggaagccctcgggtggctcgcgctcggcggtgagggtaccgcccatcccggcgatccgttcggcgagcccgatcagcccgctgccgaagcggacccgggcgtcgcccgccgcggctccgtcgttgtcgaccgtgagcgtcaccgtgccgtcggtcgacaggcgcagcgcgacggtgcagtgccgcgcctcgctgtgccgcagcacgttggtcgcaccctcgcggaccgcccagccgagggtgccctgcaccgctgcggacagcccaccaccgtcgccgatcacccggcatgcgatgccggccgaggtgagcagcgaccgggcgccggccagttcggcgtcgaggtccgccgtccggtagccgcccaccaccgcgcgcaactcggcgagggactcctgcgcgatgcggcgtacctccagcatctcgtcgaccgcctcgtcgcgtccacgcttggcgagctgcgcggccagctcggccttgaccgcgacgaccgagagggtgcgcccgaccacgtcgtgcaggtcccgggcgaagcgcagccgctcctcggccacggcgagtttcgcctgcacctcgcgcgagcggtcgagctcccagagcgcgcccagcatccacaccgtgacgcggaaggaggcgaccacgaacccggtgacgatcaccatggcgagggccggggcccccggccgggcggcgccctggccggccgcgagggcgtacaacgccagactgcccagcccgcccacggcgagcgccacgaccggacggaccgccgtcgacagcgcggccacgtacgacacgacgaggatgagcagcaccgcgttggccgggccgtccggctgccccggcgccgcgtccggatacaccaggacggccgccgccacccccgccgcggtcagcgcgccgccggccgcgaccaggcgggccgggaagggccggttaccgaggtagtgatccacgccggcgcggaccagcaggacggacaggacggtgtgcaccgtcgccacagccgccgccacccacaaggcggcacgcccgggaacgctgccggccgcgagcggtacggccgcggcgaaggtggcgtagagggtgccgcgcagatacaggtcgaggcgggccgccctgccgcgtgaacgccaccatgcagccaccgtcatgccccgcctcccaccgtcaccgccggggttcccagcggaaccggcgccgcaccgcgaccgcgcccagcgccgcccacgccgcgaggatagcgaccggcccggcggccgcggcgaagacggcgacgaagcccaccggcgcacctgcgcccgtcgtgcccagccagcccaggcgcatgagctcgaccgccggtgtcagcggcaggaaccgcacgacctcgccgacccagccgggcaggtcgtccagcggcatcatcagacccgagccgagcagacaggcgagcaccagcggcatggtggtcacctgggccagctcgacagtccgggtgaacgccgccgacgccgccgcgagcagcacgaacaccccggccccgccgagtgccccgagcaccagcacgggggcgttgaccggcacgggcagtcccaggaacaccgcgcccgccaccgtgaacacgacgatctgcgcgagggccaggacgatcgcggggctcgcggtaccggtgaggatctccacgtcggtgatctcgccgacccgcagccgcttgagcacgagccgctcgcgccgggccacgtacgtcccgaccagagtgaagtacacggcgcccaccaggacgagcccgagaaggccggtgacccggaacgcgttgcccggcaacccgcccgggtcggccttcgccgccgcggccaggccgacgatcgccagcggcggcaccaccgcgttgcacagggccatcccgtcccgcaggagcagcgtcagctcggcccggccgatcgcgcggatccgtctcatcgtgccggtcaggtgggtcatggctgcctcccggcggcgatcgacaggaacgcctcctccagcgacgccgatctggcgtcgagcccggcgaggacgacgccgcgctggtcggcccagcacagcaacgccgtcagcgtcgcctggagtgcggcggtgtggacggtgacctgcccgccggcgccggactccggccggtgcgcgccgggcagctccggcagcgcgtcgacgggaatgccggcgggcaggccgaagctgacccgcgccgggtacgcggcgaccacgtccgccaccgacccggtcgtcaccacctgaccgcggtgcatgatggcgagccggtcggccagcccctgcgcctcccccaggtagtgggtggtcagcaggatcgtgacgccctcggcgaggaggccgcggatcaactgccaggtggcgtggcggctctccgggtccaggccggtggtgggttcgtcgaggaccagcagttcgggccggccgaggagcgccagggccaggtcgaggcggcggcgttcgccgccggagagctgcttcgtgcgtacggccgtgcggtgatccaggccgaccagcgcgagcgcctcactcaccgggcgtggcacggcgagcgtgccggcccacatccgggccgtctcgacgaccgtgaggtcggccgggaagccgccctcctgcagcatcacgcccatgcgcgggcgcaccgcggcccgcgcggcgtgggggtcgtggcccagcacgcggacggtgccggcgttcggccgggtctgcccctcgaccacctccagcgtcgacgtcttgccggcgccgttcgtgccgagcagggcgaacagctcgccccgctggaccgagaacgacacgtcccggacggcctcgaatccgccgggcccgccgtagcggcggctcaacccgcgtacctcgatggcggcggccgtcatcggacgaaccgcatctcggggtaggccggcgacggcgcgtcgagcagcccgcggcgctggtggcgcaggtaccggtcgaagaaggccaggaggtaggcgcgctcgacggtgaccgctcgctcgccgtcgatggtgccgaacgccggttcgagggtgccgggcgcggcgcccgcctggggaagcagcacctgcagatcggtgaacgacatgtgccccgagtcggccagctccaactcgcggcgcgggccgcgcagatgcgcccacagcgcgtcccacgtctcgtccgcgtcgccgccgtggccgtccgagccgacctgcaggaacgggcggtccagaccggcggagacgaccggtccggaaaccgagccgtccaggttgacgccggccgtcacgcgcggatcctcgtacatggtctcggccgcggacgcgccgcccagcgagtggccgaacatcccgacccgggaaagatcgaaggccccggcgagcccgcagggcagcgtccggtgctcggcgtccgggtcgcccccgcgggcgatcgtggtcagctggtcgagggtgaaccgcgtgtcggccacccgggccgccagggccgtggcgatgacgcgttcatcgtcgccggcggggtcgtcggtgggcgccggaagggactgggtctcgatccgcccgccggggaattccacgaactgggcgtcgtgggtgtggtcgatcgtgacgacgacgtacccgtggctcaccagctcctcgacgagggcggtgctgaaggtgcgttccaggccgaagcccggcgagtacagcacgacggggtggtggcggccttcgaccggtgcgccggcgtacgcgtgggtgaccggcaggagtaccccggagccgggcgggttgaggcgcgccccgacgcccggcgagacccagtcggcgcgcgggtacccgtggacgccggccgccgggtaccagatctggaccatgatttcgcgggccggcgtggcgggcacccaggggtcggggcgcgaccggtcgaccaggtgcagcgcgacggtgccgatccggtcgtgcccggtggcggcgggcaggaccagtcgccggaccggcgcggcctgggcgggtacggcggtgagcatggcggcggcgatggccaggaccgcggcgagcgttctcctcatggccatgagtctttgcgcccggcaggcgccgaagtagtgccgatcctcaccggttccggtgcacggatcaccggcgaccgatgacagatgtcatggtgcgtgtcagctgccgcgccgcgcaggggcagtgatgggtgtccagcgcgcgtgctctgcggctatgagcggatggcgtggcgagcggcgtggcgtccggttctcagtgctgggtgtttccgatgagcgccttgctgagtaggccatggagattcttgctgaacaggcttttctcgtcgggagtaacgatcgtgacgagcgacaggccagccgtgatcaaggttgccgtgtgcggttggaagccgtagccccgatgctcgtacgggtgctcgttgacgcggattgcgattgtaggctgcggcgacggctggtataggactgcgaacgggccttcgccatccgccctgagtgagtagcccgcctcgtcccagtcttgctccatcgccgtatcgcgggcgacgtacagctctccggtatcggtcggaactccggccccacgaggtgccagggtcagaacgttccggcttttcctagtcggaccagcatgtcgggccagtgggcgtgcacgtcatcgagcatggcgcggacgctgtcgcccgctggtctgccggcgatgatgacactgtcgtatccggtgattatctggtgcctcgaacgccgggctgaaggggcgctggctcaggtggacgcatgactaggacatgatcgcagtaacgcgacatcgagtgcatccgcaattcggcgagaagcgagcgcgcccccactgcaattacttcgcgtaacgaccggatcgcggctacttgagtaagtcggtgacgggcaacgcgatgcgtagggcgtcgaacgcgaaatagcggtggctctcccggacgcggtagatccggacactgaccagaacgcactcgagtaaggtgcgcgtcgtgaactggcaggatcctgagatagccgccgttgagagtcgcgaggatctggctcgctacttgatgagcttggcagcccggcttcgcgaaggcgatcttccgaccgagaatcccaccacagatgccttcatcgacgccgcgggccgctggacgaagtccatggacggcttcttctcgaacgttctgaaggagccggttcctgacagcccagattggtcgacggtagccgctatgttccgggcggcactggtttatgagtaggagtcgagtcaagaccggggtgcccggtcgtcggcacgacaggacgtcggtccgtcggcgtcggccactggccgtgacggcacgctggcccgagcgcggacagcggcaagggggggacggccggtgttggtagcgttcgcgcacatggagtcgcggatgattcaggtagggactaccgcgttgcacgttggtgtaacgggtcacgggcctgatgttgtcgtcctaaccggcggtccaggttgtgtgcagtacctggagcgggatgaaatctcgccgctgggccatcgcgcctggtaccccgagccgcgcggcgttggccgctcgggcggcagcccgcacaccatggaagaagcaatcgctgatctcgaaggaattcgtgaggcggtcggtgtcagcgcgtggactgtggtaggccattcgtggggttctgatctgggtatgcgctacgcggtcgaacatccggaggcggttgctgcattggtcggcatcgccgggaggggtccgcagcgtgaccgcacatggtctgaggcgtatgaggccagcaaggccacggagccctttgtcgacatcgactgggtgcccgaagtgcacgcagctctcggcgagtcgttcaccgaatggattcatcgaccgagcctatggcgggcactggccgactgcagcgtgccgatgcatttcatcgcggccggcaacgacatccgcccggcgtggtccctggcgcagcttgcggagctggttccacgggggcagttctccaccgtgcctggggtgccgcatgacttctggtttacccaccctgaggtgtggacccagacagtcacaaacgcatgcgccgctgtgtaacttccgcccgcaggcacacccgcacatcggcaaagtcggatgtcagcggcggcgcgtgacctgcggtcgatgatcggtacgcgcggactgcggcaaatcagtgcactcggcgaagatacgtcaccaggccggctgttgggtggtcatcgctcgcgagtgcccggcgcgtcggtgcggctccgtcccacccaccatgcggtcgacatccatactgcgaggctcgccactcccgcgagcaggtaagtggttattccgttctgcagcgtgactaccaccgcggcagtcaccgcgatcgagatcacgctagtcgtgagaaggtaaaccaagtcggccttgccgagccggtcgaccttcgttttgagatatctcagcgggtagagcgccatgaaaatcatcacgccgttggccatcggggagatccaccagggagaagaagtccaatcgcccaggatcatccctgaagtgccagccacggtcaccgataagcccatggcgcctatatcccgacgacgcgcggcaccggcggtgttgttttgcaccatggatcgatgctcgtccgtgaggcggaccggcgtatccggcgaacgaccctgagttgaccctgagaaatccaacgtggccgtcggcccgtgcttcacacccgagtaggcgtagaaacggatcggtcaaagccgggggcgaccgcacgctctgcggcggaagtgcgcacgaacaccagctcgtggacaaggacagtgaccgtcgcgctgcccgacgcgtgtggtcggcgcgtgttggctcagctggccgacaagcgccatctgtcggtcatggcgacgatgccggcggccaccgcgtccggatcgacgagttggtggagatggtgtcccgcgacctgggcgacatcccagccacgttcgcgggcgtcctgcgccatctggtcatacggcgacccgaagagcagatacccgcatggccggcgatcccagccgtcgggtacgggaatctgctgctcgtagtagctcagtggcagccgtggctgttcggccgagatcgtcaatctggtctgcggatcgggaaacagcgccgcgacgtcctcctcgtcccaccaggctgtccactgtggcagccgaccctcggtcacctgggtacgcaggtgggtcagccgctcgggcgacgcggtcggcgtcggcccggttcgagagggcagtctggcctcgacgaacaggcagccggcgaccgggcgcggagccgcgtgcacgattgccggaacgaacagaccggcgttgctgtgtgcgaccacgaacaccggttgattcggcggcaaccgggcgacagcattgtggaccctgtcgacgacgcgtggccagaacggcggatcgtccgcatcggtgacgtcgaccaacgacggcactaccgccgatgcgcccgaggacgccagcttggctgccaccggggcccatgtcagaggacccaacagcaggctgtgcacaagtacgaacgcggaacgcaccgatccaccattgcaccgcccggctacttcacgccgttccggccgatctccggcaaccgcgctccggctacagctcgtgacgggcacagtccgtgcccggcgcgcgcggacggcagcctcctgacgtggcgctcgatctgcgccgcgcaggcgtgcgtgcgcgtgggccagcaggggatctgaaatgtacagctgtgcacgaactcctttgcgacggcttccgcaggggtgatcatccccaccgtcaggaagcttccgatcgcgtcgggcgctgaccccggcatgacgacgtctcctctaggacctgacagtgcgcttctgcaaccggtgacagccggtgcgttgcaggcgtcaaaccgcatttggatggccccgctgacccgtaaccgggcgaacccggacggcaccccgaacgagctgcaggccgagtattacggtcagcgtgcgggcgctggcgtgatcatcaccgagggcacgcagcccgcggcggttggtcagggttacccgaacaccccgggcctgcacagcgacgcccagcaggacggctggcggcgcatcgccgaatccgtgcacgccgccggcggccgggtcgtggtgcagctcatgcacgtcggtcggatctcgcacagcagcaccatcggcgggcagacgccggtcgcgccgtcggccgtccgggccgcgggcgagatcttcacggcagagggtctgcagccgttctccgaaccgcgcgccctggcgaccgacgagttgcccgcggtgatcgcggagttcgccgacgccgctcgccgcgcggtggccgccggcctggacggggtggaactgcacgccgcgaacggatacctgctgcaccagttcctcgccgacggcgtgaaccggcgctcggactccttcggcggctcaccgcagaaccgtgcccgcttcgtcgtcgaggtcgcgaaggcggtcagcgccgcgatcggcgcggaccgggtcgggatacggatctcccctgcgcacccgttcaacgacatccacgaggatgacctcacggtctacgaagtgctgaccagccagctcgccgagctgggtctggcctacctgcacgtgctggccaccccggacgacccgatcgtcggcaaactgcacgcgatctggccggcgacgttcgtcctgaacacaggtttcggcgtggagtcagaccgcgatggcctcgagcggctggtcgccgacggcgtcgccgacgcggtcaccgtgggccggcccttcctggccaaccccgacctggtccagcgctggacgctgggagctgagctcaacgagcccgaccaggccaccttctacgccggcggcgcgaagggctacacggactacgctccgctgtcctgacgccaggtgctctcgaccccggttcccgatggggagccggggtcgagcccatgccagtgttcagctcgagcttgcggcggtccaagccctacagaccgcggcagcgccgggtcatgatctacctaggccgcggcgggtcagccccgcgggtgcagccggtcccaggtcctatgaacgaacagtagccggtaagcggatacctccctcggttgcgcgcgacggccccgccgccggactcggagcaactaccgttttagggtccatggcatgcattccaacctcaccgaacacgctcggtgccgctacggtgatgaataccgacccgccgtcatcgcgcagtgctctgaggatcgcgacgatcgatacttcatcgagaggttgaccttcgccgacgcggaggcgatcgcggcgatgttgcatgagctgtgtccgaatatcgttgacggacttctcccggtatgggtgcgcaacctggcctatcggctcttgcttctgcaacgcccggacgaccccgccttgatgcgcgaggctgcacagagcctctgggtgcatgggccggactgggatgacatcgccgcaggcctggaatgccgcgccacggcgctggaagcgggctgagcggcagccggcggccttgacgggtgtccagatctgccgcagagcacgcacgctcgatccgggtcaccgcccgcggccggcactcgcggcagtcatcccgggatggcgcagcaggctggctctcggcgaccgcgggggcggggccggaggatggacgacaagctcagcgccgaggaccgggcgtcggccgtacgcggtgcgaaggtcaccgtcggctgcacagtggacggcgcgaatcatcgcccgcagccgtcgattgaccctacgatgggtcgagaacgtactttccaggagaggcagagggtcgtggagagcgccggatcaggcgacgcgatcggggatctccgcgccgcggtggcgaaggcgaacgccgagctggcgacgctggcgcccggcccggcggcatatcgtcagcggcggcggcaggtggtgcgggcctcggggcggctgcgtgagcgggagacgttggctcagcggcgcgccggccacctccgggacatgcgactgctgggcgtcctcatcggcggcatcgtggcggtcgccggcgccggctcgtgggtggcgatcctggccggcctcggcctcgcgctgctcttcggctggatcgtgggccggctgccggaccgcatgttccgctgacgggtcagccctccggcgggatgtgtgcggcggagacgtccgtggcggcgcccacccattcgacgatctgttccccgtcgagcagcgggacggcccgggaccgggtccacccgagggtgccgtcgggacgcgaaggtcacattttcggacccgccagccggaccagcgccgtgtccaacgcctcgcgccggccccgatcggccgcgatggcggcgagttcggtcagggtggcgagccgccgcgaggccagggcctgttcggtgcggtcggtgaccgccgcgacgatgccgatcacgacgccgtgccgtcgcgcagcggcatgaaggtctgctggaaccatccccgggtcagcgccgccgcccggcggaagtaccgatcaccgcgcggcgttgcgcatccggatggcgctgaactctcccccggcctgcaccaccgcgtcgacgtacggccacagcgacggggtcagccgcagctccacgtcgtgggcggccagcgcggtgaaacagtcgtcgacccggcgcaccgcggtcacccgggcgggctccgcggacacccagtagccggcggtggcgtcgagcagcgtgaaccccgccgggtcgagcaggtgcacgttcagcccggcggcgagcaggcgtgacgcccacccgtgctcgacggcgaccacccgggcggccggcgagcacagcaggtcccgccgcggcccgcccaccgcccagcacacccgcgggcactgccggggcagcaggtagtgcggcaggtgctcctcgtcgaccgcccagaccagttcctgcccctcgtgcggggtgccgggcggcgagggccgcggacgcatcgtggtgaacgggccccggtcgctgacgtggtagagctgcggcacccccgcaccctactcagagtggcacccggcggcgggcggcctggcgggccgggtcggcgaccgggaccgccgcgagcaggcgtcgcgtgtacggatcggtggggtggtgcaggacgtccgcggtcggtccgacctcgaccacccggccgcggtgcagcaccgcgacccggctcgccaccgcctccaccacggccaggtcgtggctgatgaacaacgccgcgaagccgagttcccggtgcaggcgcagaatcagctccaggatggtggcctgcaccgacacgtccagcgcggaggtcggctcgtcggcgatcagcagtttcggccgcagcgcgagggcacgggcgaggctggcccgctggcgctggccgccgctgagctcgtgcgggaaacggcgggcgtacgcggcgggcagggccaccaggtcgaggagctcggcgacccgggcggcggtctgctgccggcccaggtcccggcggtgcacccgcaacggttcggccagcgagtcgccgatggtgagcagcgggttgaagctggtcgccgggtcctggaagacgaagccgaggtccggggagcgccggcgccggtggacgggggcgccgaggacggtgaggctgccgccggtgatcggggtgaggccggcgatggcccggccgatcgtggtcttgccggagccgctctcgccgaccaggcctccaccagatgccggcggtcacgtcggagaccgccttgttgaggtcgtaaccccattcggcggccgagttcggttcgatgccgaagccgaggaagccgagcgcggcgagggtgaggatggcttcggcggcgttgatggtgacgatcagcggcagcgtgcgggtcgcgttgcgcaacaggtggacgagcaggatgcgggtgttgccggtgccgatcacccgggccgcctcgacgaacggctcggctttgagccggaccacctcggcgcgcacgacgatcgagttcggaaccgcatcatctccggacaactatccgaccccatcactccgccggaggcacgcaaggcgtcgttacgtagaccaacccggcgatctgcacgaagacctcccgacgctcgattgccctgccgctcgcgtcgatggagtacccgatcagccagacccagccggcgtacgtctcccgcggatcaacgcggatgatccggaagaccatcgcgcaggcgccggcgaactgcacgctcgccttcgtggtcaggcggaccacgtcgccggccctcggctggcggagcggcgaaggcccattcgaggactcaggccgggcgttcatgcacaccgtcctccgttcggaaggcctgccctggtcaccggtcggcctgatcgtgaagggccgacggcggcactgcctgcgcgctctgccagtcacgcaatgcggtcttgatccggtagttctcggcgtacaccgcggccagctcctcatacagcgaagcaatgtccttcgagacctggttgacgaactggcggacatcgtcggcccgtacgccctggagcaaccccgcagtcctccggaaccgcacctctcgaatggcctcgggggtaagccggccactgctccgcactcggaacgcggtgccatgcttgccgctcatcgaaccgccccggttcggacaccccgcacgacgccaggagtccacggacggccagatgccgcgccacgcaagggatgaactcactcggtatgcaggtaatgcagaagccgtccgcatccggccggtgatcgacgagcagtcggaaggacaggtgccacatcagctcgtcaccgcactccatcggcggacgcgccggcgggtcgtctatagcaaaggacaggtcagccacttttcatcgcctcccacgaatgcgcccgctcgtcgacgcagcgagcgtgcccgacactggtcaccacacccgcgacgcgacacccgtggtcgcatagtcagggcagccacggcgcacaagccgaaccgtgttctcgtcgacccgcactgcccgacgcggcgaggccaaccgccgaccacggccctcgcagccacgacacgacccggcaaactgatcgttgatctgatcgctcgtcatgcgtaaaagggtcggccgcaataccctttcaacccattccgcggcggtatcccttgacgggataggcgatcggcaggccacgatggatcacgagacgtcgaagccctggcggagggacgtgccgttgaagtccgaaattcccggctccacctggaaccggcccgacatgctcaccgcgttgcagtcgcgcgacattgctcacgtgttccgcttggtgcgccagcacgccgggatgtcgcagaccgcgatcggcagcctgatcgggatgagccagggcaaggtcagcagcatcatggcgggaagccagcaggtcaccacgctggaggtctacgaacgcatcgccgacgggctccggctaccggacaccgcgcgcatgacgctcggcctggcgccgcgcagcatctcggcccgggatggttcccactccgacgcaacgggcacggtcaacccgacgcgtagcgtggagagagatccgcgaccggaggaggacaacgccgtgcgacgtcgcgagttcgtcggcctcaccggggccgccctcttcggcgccatcctggcgaagaccgagccgaccgatcaacccacaaccagcggcaccgacgacctggccacagccctcaccgagttgccgacgccggccgccggcccggtcaacctctcccgcctatccgcgacggtcgccgccgccaagcgcgtctaccaggcgtgcaagtacggcgaagtgctcacgatgctgccgccgctcctgcggtccctgcgcaccgcgttgaccgccaccgacggcgctcagcagcgcaaggctcaggcgctgtcggccgaggcgtaccacgtcgccgcctcaatcctgctcaagcagggtgataagggacttgcgtggctggcggcggaccgcagcgtccagaccgcgcagcaaaccgcagtcccgctgatgatcgggtccagcgcccggatcatcacccacgctctcatggacggcggccaccaccgcgccgcagccaccaacgccagcagcgccgcccagcacatggacgcggtgctcacccagccgaccgacaatgacctgtccgtctacggatccctcttgctccgcggcgcgatcgcagcagcccacaacgccgaccgccacaccaccatcgaactcctcgatgaggcagagcaggccggcggccgtctcgggcacgagggcaaccacatgtggaccgcgttcggtcccgacaacgtgctctgccaccgggtcaacgcagcgctgcgatttggcgacgctggcactgccatcgacttcgcccggcgcatcgacttggacgcgttgcccatcaacgaacgcaaggccgtgctcctgctcgatgtcacccgcgcgtttctcatatggggcaagcacgaacaggctctccacaccatgcgggccgccggccagattgcccccgaggagatcaccggccgcccgcggatccacaaactcgtcggcgacctggtcgctaccgcgccgatcaccgtccgccgcgaagcccgcgagttcgccgacgcctacggaatcgccgcatgagcaccgacagcaaggttctctacatcatcgtctgcgccgccggcccggccggtgaagtgggcaagctggtcacgctcgcccaggacgagggctggaccgtccagatcatcgccacaccgtcggcgctcgatttcattgacgtgccagcactggaggaacagaccggccgaccggtgcgcagtcgataccgcaaaccggacgagccgaagagtccgagagcagacgcaatcatcgttgccccggcgaccttcaacaccatcaacaagttcgcccaaggagtcgccgacacctacgctctcggcctgctggcggaagcgcctggactcggcatccccgtcgtcgtcctacccttcgtcaatactgccttcgctgcccgcacaccattccgccgaagcgtcgaacaactccgactagaaggcgtggatgtccttttcggaccaggaaagttcgagcctcacgctccgggctccggaggtgatggcttcaacggctatccttggcaactagcgctggagcgagtaagccggcgagacccgaccgggccgtcattttgatccattactccgagctgcgttggtggccaccagggtcgaggagaaatggtcatcgcagggccgcgacgaaacccgccaggttgtcggccatcatcacgtggccggcgcccggcaccaccagcacctcacagcccacgtcccgcagcggcccgagatcctccccggacagctcaccgccgatgaagcggcgcgggccgtcgaacgcggccagctgctcgcggaacgtcgccggccgcccggccagcagcgacaccgccgtccggtgcagtccccgcggcgaccagcgggccaccgtgcgggcgaactcctggtcgacggcgcccggctcggcccgcaacgcggccacgatccggccgtgcccggtggcggcgaaggtgtcctcgtcgaaggcggcgatcgtggccgagaacgtgccgacccccggatccagattcggctcggcgacgatcagatgcttcaccagatcagggcgctgcgcggccagactgatcgcgatcgacccgcccagcgaatgcccgaccagcgtcaccccggccaccccgacggcgtcgagcaccgtggcgacggtcgccgcgtgctcgtcgacggtgtggccgaacgtgtcgtcgtgatcgctccacccgctgccgatcaggtcgacaagcaggtgacgacccgcgacggccagatccggatggccggtcaccggggcgaacaccaccgtggaggcggacccgagcccgccgatccagacgcgcaccggatcaccggcaccgagctcgagaacggcggcgcgggcaccggacggtgtgacgggaacatatcgcacccgaccgatggtgccagaaagctctaaccgagcagtgaacgcacccgggcatcgttgagcaccagcgtcaccgcggcgatccgcgcggcgaacgtctccgccaggtgggcggcgaccccgtccagcaactccgcccgctcgtcaccgccgtcgaagaggtcaccggcggggatcaaccgagccggccgggtcaacgctgcgagtactgcggtcactgagttgtctccagtcccccgccggacggttcccggcaacgatgaccccgttccggtgtcaccgggttgccgcggacggtccgccgggttgttccctccccgggcatggagtccgcatggtggttaaggtcgacgacacatcgatcggcacaacagcgggggctgggcatggacagtcgcatcgagcggtcacggcagctctacgaacgcatggctttcgacggcgacggcagtggactgccgatcgcggagcgcgaactcgacggtgtcgaagctgaccttgcgctggcgcgtggacgactcgcgcacggccgcttcctccgggacggtcaggaagatccgcaggaactggcgtttttcgcccgcgccgcagaactctacgaggccttggacgacagccgcggtgccgctgaggcactgctctggatcgggatcttccatcagttcatccgggacgacgatgatgccgcgatgccggcacttcatcgatcgcgcgagctcgccgagcaggccggcgaccggctgggcctgtcttacgcacttcggcatctcggcatcgccgagcatcgggccggccggttggataccgcgcgagagcacctggaggagtcgacgcggctgcgacgagaggtggactttctgcccggcgtggcggccaacctggtcggactgagctacatcgccgctgcccaggggcgccgggacgatgccatgaccgcggcggcggaagcgggcaggatcgccgggtcgaccggcgcgctcgccatcgcccgtcaggccgaggaggcactgatccgcatatgaccacgggacgatcatcaagcatgcactcagccgggtggcacctcaccgaagacgtcgaccacttcctcgtccacgccggagacttcctgcgttcgcgccccgcgctgcacaccatgccgctgacgcggatcgaaaccttccggacgcgtacggccgaccgggccggcgcggtgttcggctggctggaatcgggaggcggggtccgcgccttcttctaccggctgcgccccttcggccttctgaccctcaccggcgtctcccgcgagcagtccgacacccttgccgccgagttggccgcccgcggcgattccctgaacgccgtccacgccgagcatgacaccgccaccgccttcgccgaagcctggaaccggcacaccggcgctgacccgctcctggtggcacggacgccgctctaccgtctcgacaggttgaccccgccacggcggccggccgagggtcatgggcgcaccgccgacgcgcgcgaccatgagcacgtcgtgcgctggtgccgtgagttctgcgccgccgtcggcgaagaccggtccatccagatgatcgatgtcggagactgggccgccagccgcttcggcgacaagcattacaccttctgggagaccccggacggcactgccgtctccatggcgggttggacctcgatggtctgcggcatggtccgggtcgaccccgtctggacgccggcccactaccggggccgcggctacgccggcgcggtgaccgtcgaggtcagcagagccgcgctcaccgcgggcgcgaccgacgtcgtcctgttcgccgatgccaccaaccccaccagcaacgctctctaccagcgcatcggatatgtcccggtcgccgacttcgccctctaccgactcccccggaccgcggcatgagccagcacgtcaaccgctcctggtggtctgtccgaaccgcgtcacgctcggcctcagcgctgtggccgcggcactccgccgcgacggtcctgaccacgtagccgttcggacggtgaggatcagcagtctcgctcgcataccgccaggctgcgcaacgatcggccgggcggatccaccggaggagaatccattggtggatccccgttccaccgacccgtggattgacacagagttttgggccgcacggctacgatccgggcggtgccgatcacctttcccacccatcccgccgctgtccttccgctgaagttgtggcggcccggatggttcgacggggtcgcgttggccctgggctcggcggcacccgatgtggcctatgcgctggacggcagcggcctgccggtctggccgctgtcgcaccaggtgcgcggcctggtgctgtggtgtctgccggtcacgctgctcggctgtctcctggtgcgccgcgccgtcccggtggtcgccgcccatctgcccggcggcgaccggctcgcgttgcgcgactacggcgccttgcgcagctcggcgcatccctggtggatcacggtgctttcggccctgatcggcgcggccagccacctggccctcgacgggttggagaaactgatgccggcggtggaactccccggccacgcggtcggcgcggtcaccatgacggtgctgttgctggtgatcggccggcggcgcctgatccgccgctggcacggcgcgccgccggtgcgggagcggcgtccactgctgttctggtccgtggcggccgcggtggcacttccggtgctcacggtcaccccgctgctgccgggcgccggcctgctgcacaccacgggcgtacgcatcctgtccgcgaccgccctgggcctgctcctgggcgccgcggccgtcggagctctccatcccgagccggcccgaacctcctgaaccgctgacgccatgcgatgcgatgcgggactgtcgcccggcggcgaccggacgccattccgccactcggacgatcgacggtggtccacgcgacaaggcattttccggccggcgacgtatcgatggatcacccatccctgaacacgatgcttcggtggagggggactctcctggctgacagagcgagtgccttgatcattgtggtcaccgcaggtttgaccgcgtgggtcgtctgggcatgctgcggtgcgaacgacccccgcttaccaaggagctcgacgtgcacgtttccgggatcatcaccgccatcatcatcggcttgatcatcggcgcactcggccgactggtcgtgcccggcaagcagaacatcccgatctggctgaccatcgtcatcggtatcgtcgccgccatcgtcggaaccttcatcgcctccgccctcggtgtcaacgacaccaagggcatcgactggatcgagctgctcatccaggtcgttctcgccgcgctcggcgtcggcgccgtcgccggcctctacggccgccgcgcctgagcgccgcaaccagcatcaccttcgacgagccgttgcccgagggcagcggctcgtcgcgtcgagagccggctaactgcccgccctacgttgcagaggcgggtcgcaccgatcgttcgttggaccggttgaccccagcgtctcggtatggctcagtgcctgttgccgcggatggattgcgagacttggccgccgagacgccgtgacgacccgaccgccagctgctggaaatctttcccacggtggagcggacaatgacgctgaccaaccagggacggtcattctgctcaacggtttatcaaacgccggcggtcccgagtctgaagcgcgggtgctcggtaaggtctcgagcgtggacgttgtcgtggtcggtgccgggatcgccgggctgtcgtgtgcgcgagcattggcggacgctggggccagtgtgcgcgtcgtcgaacgcggccgggtcgtcggcggacggttggccagcaagcgctacggcggccggtatgccgacatcggagccgcgtacctcgtcgccgacgacccggacttcgccgcccaggtcgccggttggcaggccgctggactcgcccggccgtggaccgagtccttccgggtctacccgggcggccgggatgccaccggcccggtccgctgggctgctcccgacggcctgcgatcgctggccaccgacctcgccgccgggctggacatacgtctatcaaccccgctcgacgcagtgccggccgacgccgacacggtggtgctcgccatgcccggcccgcaggctctgcggctggccccaccgccggggatcgcggcggccgcggccgcgcagacctggcatccggcgatcgtggccgttctgcgctacccgctgcgtgagtgggacgacctgcgaggcgccttcgtcaacgaccatcccatactcgccaccatttgcgacgacggcgaccggcgcggcgacggcgcgccggtcctggtcgcccactcaaccgcagaactggccgccaggcacctgaatgcgcccgaggcggccgggccgatcctcgccgaggccgtcggcgagttgctcggtctctcggccaagccggaggtgagcgtgcaccgctggacctttgcccagcccgagcccggcaaggccctgtatgccgtggacggccgggtctggctctgtggcgatgcgttcggccgcccgcgggtccagaccgcctggctgtccggccgctccgtggcaaaagccctactcggctgacccaggcttgcgcctgcctcgacgccgtacgtgccggtgcccgaccctggcgggcctagcccaggtgcggtgttccgccgatggtctccgtccgccggtacagttgcgcaggtgacggacgagctgtgggacagctacgaccgggacaagctgcaggctggctggtcgtatccggtcgggcgaaccaccgtcgaagcaacgctgcgagccgctggcgtccatctgctttcgctggacttcatcatgcacggcggcgccacgacggaccccctcctgctccgggcgacccgttatcgggacatgggcaacacgtacttcctgcagcgtgggacctccgagcggtcgcgctgcgtgctcgcgctctatgccgttcctagcggcgttcgcgcccaggcccgtgctgttctcacgacgggaggcgggcttgatcgcgcttgcgcatggctcgcggccgcggaggccgcagacccgacctggcactacaagtcacacggctggacggcttccctgatcaacggcgctctgcagatagcagagacaactgaatgaccgcggtgccggccgcgtctcgaggcggctgcgcgtagccggcaattcggctacggcggcgtgatggcgctgatcctgctcggcgccaccgtcctggatcggctgccgcgccgggccggccggctctgacacgaccgaccttcccgccgaccggaccggatcctccgggtgatccccgatgtggcgaagcgaccgcgctgaacacccggtgcgggcggcccgagctcgcggctcaggcggccacccggtcacggccggaacgtttcgcctcgtacaaccggctgtcggcctcgtgcagcagctcggcggacccggcgcggcccagcggcgcgacggcgatcccgatgctggccgtcaccggcaggtcgccggtgatcggccgccagtcgaagcggcggacggtttcgcacagcaacgtcatccgctcggcggcctcggcggcgccggccccgggcagcaccaggaggaactcctccccgccgagccgcgcggtgaacgagcccccggctccggcggcggcggtcagcagggtcgccatctcgcgcagaacccggtcgccggcctcgtgggagccttggtcgttgatctgtttgaagtggtccaggtcgacgaccgcgacggcgagcggctcgccgttctcggcggcccggtgcagtagcagcggtagctccgcatccacgtagcgccggttgtacagcccggtcagcggatcacgcagcgccatctcccgcagaccggtcgcctcgtccaactggtgcagcgcgtgcagggtccgggcgcgggcgtcacgttccgccgactgggccgccatcgccgcggcgtggaaccgcttgtgcacctcgaacgcctcgacgtgccggccggacgcggcgagcacctcggaccgttcgcgcagcagctcgatcccgaccgagcgcaggccgcgctggtcgaccagggtctggcagcgatccagcgccgcgccggccgccggatagtcgccgcagcgccggtacgtctcggccagcgtgagcagcaggctcgccgtcgtgttcagctcgctgaaggcgtcgtcggtctccaccgcgacgagcggttcgagcagcgcgatcgcctcggcgtgccggccggcgttcatccggatccgggccaccgtgtccacgccgctgtggtccaggtccagcccgtggaaggcggcggcggccagcagccggtcggcggccgcctccgcggcgtcgatgtcgcccacctcgtactcggtgtaggccaggttgttgagcacggtgatccggacccgggcgtcgacccggccggccgcgatctgccccgcggacatccgttcggcctcggcgtaccgggcccgggccgacgcgtggtcgccgttgtcgccgtgcacgttggccagctgcacggtgccgcgcagccgcagcatcggcgaggcctcggcgcccatcgcggccagggcctgctgcgcctggatcgcgtggtccagggcgacgaccgtgtcccccaggtggctgtagaacagcgacagccggatgtgactcagcgccagcagccgcgggtgccggtgttccacggcccaccggttcacctcctggaagatccgcgcgccggtggccacgtcgccggtccggctcaccgcgtcggcctccagcaaccgcgcccgcattcccaggtcgcagcgcccgccacgcagcgcggcccggcccaggcggccggcctcggccagggtcggccgcgggtcgagatcctggcgcggcgtctcctccagcacgaccagggcggcctcgatggcggcgtccgcgatcccggcggtatcgatcgacatggtcctgccatcggccgcccggggccacacctgacgagaaccgccacaagtgaacgttcatcgttccgccggcccggcggtattctcaccgggaacgtggcgcaacggggaggaccgagacgatgagcagcgccggttccggccgtccccgcgaccccgaggtggaccggcggatcacccgggccgtcctggacgtgttcggcgaggccggctgggccggtttcgcgatggagaccgtcgcccgccgcgccggcatcggcaaagccaccctgtacctgcggtggagcagcaaggaggaactgctgaccgacgcgctgaccaccgggctggtccgggtcggcgatgtcgacaccggcaccctgcacggcgacctggtcgagctggccacccaggtgctcggcctctacaccggcccggccgggcgggccgcgatgcggctcaacctggagaccgccatcccggaggtcgccgagcactaccggacgatgcgcgcctcccagatccaggccgcccgcgacatcgtgcgccgcggcgtcgcccggggcgagctgcccggcacggtctcggtcagtctgctgttggagacactgatcggcggcgcgatgatgcacgccatgaccaccccggccgaccggcgggccgcgctggccgaggaggccggcagccacgcccgccagctggtcgacttcctgctgcacgcggtggccagcccggtcgcggatcggcgggcccggacggggccgttgttccgcgcgccggcctgaccgtcgtccctcaggggaccaccgtcaccggccagcggccgcagcggaccaggcgctgcgcgaccgagccggcgatccggtgcagcaggcgctccgaacggcccacgatcaccgcgtccgcccagaactccctggcggcgtggcacagctcggtgaacgggtcgccgtcgcgcaccacgatctgcatgtcgacgcccagccgggtccgctcctgctgcagcgtgtcgcggaactcggagaccaccgcgtcctgcgaggcgaccatcgtggcggcgaccgtgccggacgagtcggccatcgacaccatggcgccggccggcggccggacgtagacgccgaccagccgggcgccctcccggcgcgccaggccgaccgcataggcggcggcccggcgggacgactcggaaccgtcgatcccgaccatgatcacacccggtcccacggcagcctccttcgaccaccccgttactgaacgatcatcgttcacttaaaggccactgtagtcccctccccctgctccggcaacgaagggcctcagcccttgacgacggcacaggcgtacgggctggtgccggatccgctgtaggcctcgacgtcgaggtagtacgagccggcgccggtggcggtacgcgtataggtgagtcgttcgtcggcgcccttgccgtcgttcaccgagcgcgccaggccggccccggagccgtccagcaggtacaggtcggcgtcgtactggtcgggaatcgagcaggagacggtgaccttctgattctgggtgagcgagagcttgaagtagtcgcggtccgaggcggacttcgccgagccgctgacggtcagcgggtaggtcccggtgctgaggtcgttggcggtgccccgcgagtcgttcggctcggtctcggtcaccgcgccggcgccgcccgagcagtccgcgatcggcgttccgctgtagaggcccgggtcggccaccccggcggtgacgctgcgcaggtaatagccacaggtcggccggttggcgaagtcgaaggtgccgcccccggtcagatgccagatcttgaagccggtgtaggtcagcggccgcccggcgacggcctgctcgggagcgtggtcgccgagaacgatgtaggcgtccgcaccggcgagcgtggccaggcccgcccgatccacgaacagcgagccaccctgctcgatgccgacaccccaggccttaccaccggtgaccaggccgtccttgagggagcgggcgacgaaggccatggtgcgtcccatccggtcgcgggtcacgaaatgcgagtcgttgatggtgccggcgtagtgcggccagctgaacatgccggtcgtgaaggtcacggcgccggtgtacgggtcggccagcgcctcggccgaggtgacgctcccaccgcaggcgtcgtagacgatgtcactgttgatgtgggtgccggcgctgccaccgccgacgccgccccccttggccacgaccgattgcaccgacgcccgcagtgcggtgctcttccaggcggcgtacgcgcactggtccccgccggcgaagtagacgaactcggcgttgcggatctcggtgttgaccgcggcgtcgtcgccgtcgcgcgccgaggtcagcacgagggtcgtgcacgcgttgacaccggcgagcgccaggacggcatcacactccggggtggcgctgccggaaccgggcggggcgtcggccaggaccacgacgtccatggtgccggcgcctccggtgatcgcggtgacggctcgggtgaacgtggccggcacgatcgcgccggctccggagaagacgaacgccggaccgttccatccggtccgggagacgtccgcttggttgccggcccgggtccgggtgacggccgcctgggcagcggtggcatgcacgccgccgaagaacagcagggcgccgagggcggcggccgccgtgaggcgacgccgcaggggcgtggtgagggtcatcgagggcctcctgtcaggccggtacggcggagatcgccacggtgaggtcgaggaaggagtcggcggtgcgtccgtcccgcgtgtagccgcggaagtcgtgtcccttggtcagcgtgaccgcgaaccgggggtcgctctgtgccgtgtagccgacggcgcggcgggtgtccgccgcggtcagggcgagcgcgaggttgagctgctgatggtcgccgaagatgtcgttgttgtcggggacgccgcggtgcgcgggatccgcccgcagcgggcgcaccgccggcggcggggtgatccggccggtgccgggctgatagtggtaaccggcggtcaggaagctccaccggacgtcgcggtacaggtcgatcacgttgaccccgccggtcccgatgacctggccgcactcgtgggcggttccgggatgctcgacgaggtaggcggtgtccggatccacgccgaccaggtggtgccggccgaccgtgcgggcgagcacgatgccccggcccagccggccgtaggcgttgaagtgggtgtccagcagtgccgaggtgaagaagccgaagccgcccgcgggccagtacccggacacgctggagtcgtcgaagtagccggcggtggatccgtcgcgcagcgccgggtagctgtctccaccggtgaccatgtcgtgtccctgctggatgtcggcgcccgcgctggagccggcgatcaccgccccggcgcgatgccggcggcggatggcggccagcacggcggagtcggtgtgcgcggcgccgtgcatcatgcaggtgacgtagcggaactggtcgccaccgccgaagaagaagccggtcatggtggcgacccgggccgcgagctgcggatcgtcggcggcgccgacatggtcgaggtcgacggggatccactcgacccgcccggcgccgtacgacagcagcaaccgccggtagaactcgccgttggcggcgctgttggacgcgtcgggcgtgccggcgtccggatcctgactgggcggcaccgacgcggcggtgagcaccccgatgtaggccccggcgccgccggcccgccggacgatctccccgtagacagcggcgttgtcgtcggccaggccgccaccggccaggatcagcgggccggtggcgggacgcgcggcagcggccgcgggggtgccggtgagtgctgcggtggcggcggcggccgagccggcgagcagggtgcgacgagtgaccatgcaaacctccagagggcggcggccggccgctgcgcggtggccgacatcgatgcgatgtggataggcacgttacggccacgcgaatcattcgtctatatgtaacatcgattacggctgagccgaggatcgccgccgatgtaacgccgcgtgccggcccgtttaggctgatcccatgtcgaccccgaacgaagacctcggccccgcggtgggcgtcgccggcctcatccgggcacgctgggccgagtgcagcccggcggagcggaaggtggcccgcgtgctgctggcggcctatccgcaggccggcctggagacggttgccgccctggccgggcgggccggcgtcagcgcgccgacggtgctgcggctggccggccgcctcggcttcaccgggttccccgagctgcagaaggcgctgcgccaggagctgacggaacgcgacgtgtcgcccctgacgacctacagcgccgggcgctccaccgcggccgcggacggtggcgccctggagcgcgcggccgccatcctgcccggcgtgctcgccaccgcgctggccgagacgccgccggcggagttcgacgccgcggtccggctgctggccgaccggcaactgacggtgaccctggccggtggccggttctcccggctgctcgccgaatacctgctgctgcacctgatgcaggtgcgcggtggggcacggctgttgccggcgggggcggtcgaacgcgccaacacgctggtcgacgtgggccgccgcgacctgctcgtgatcttcgatttccgccggtacgaggattggtcgctggcgctggcccgcgcggcgaccgaggccggcgcccgggtcgtcctggtgaccgaccgctggctgtcccccatcgccgcggtggccgaggcggtcctggcctgcccggtcgactcaccgtcggcatacgacagtttcgtgccggctctggccgtgctggagaccgtgatcgccggtgtcatcgaccggctgggcgccccggccggggagcgcctggcccgcatcgaggaggccagccggcggttcactctgctctgacgctcattacatcgatctgtaacttcacatcatctgtatcctccgttacagtgccgcttacccagcaaggcatgcggaggacacatgagaatccgatacccacgacagaccgccgtcctggcggcggtcggcaccgcccttctgttgaccgcctgtggctccaccccgtccacggccaccaccggtgggtcggccgccgccaccccggtcacggtcaccatcgccggcgccgggacggtcaccaccgacccggcgctggccgcccgggttccggccgacgcccgggccaagggctcgatcacggtggcgaccaacgccccctacgcacccttcatcgacttcaagaccaagggcgaccagagccatttcgtcggcctcgactacgacctgttcaccgcggccgcggcccggctggggctgcgggcgacgttccagcagcagccgttcgacggtctggtacccggcctgcaggccggcaagtacgacgccatcgccggcggcgtcaccgacaagcgggaacgcgaacaggtcgccaccttcgtcgactacacggcttccggcaccgggttcctggtcaccgccggcaacccgaagcaggtgtccaccgtggcgaacctgtgcggcctgcgggtcggcgcgcagaaggccagcaaccaggtcgacaatctgacggcgtacagcaaggcctcctgcccgggacagccgatcgtgatcagtcagtacccggccaacaccgacgccgtgcaggcgctgctggccggtcaggtcgacgtggtcgcggccacccgggtcaacctgaccgacgtggtgacccagctgtccggcaaggtcgccctcgccgacgacccggcggcgcccaacggatggctggccagcccgaacggtttcggcttcctcaagtcccggggcgagctggccaccgccttccaggccgcgctgcagtcgttgatcagcgacggcacgtaccgcaagatcctcgatcagtggaagcaggccccgatcgggctcgccacgatcaccgtcaaccagccgatcaactgaccgtcgacccgcgggggcgtcgctggcgcggcgcccgccgcagtgaaggaggctcgccatgagtgtcgatgccgatgccgccacggcggccagcgtcgccggaacaccgctgcgcgtggtcccgctccgccgcccgggacggtgggtcgccgccgtgctggccgtcgccggtctggccgcgtttctgcaagccctgctgcgcagcccgaacctgcgcctggacgtgatcggcgagtacctgttcaagccgtacatcctgcacggtgtgctgaccaccgtgtggctgaccgtcgtcgcgcagctgctcggcaccgccggcggcaccgcgatcgccatcatgcggctgtccgcgaacccggtcctgcgcgcggtgtcgtggctgttcgtctgggtgttccgcggcacaccgctgctggtacagatcatcttcttcggcttcctcggggccctgttccccaccctcaccctgacggtgccgttctccggggacatcctgtggagtcgccccaccagcgtcgtcatcaccggcaccgtggccgccgtgctggccctctcgctcaacgagatggcctacgccgcggaggtcatccgcgccgggatcctctcggtcgaccgcggacaactcgaagcggcgtacgcgctgggcatgcggccccggctgaccatgcgccggatcgtgctcccgcaggcgatgcgcgtgatcatcccgccgatgggcaacgacaccatcaccatgctgaagtccaccgcgctggtgtcggtcatcgccggaagcgacctgctcaccgtggtgcagggcatctacaccgccaactaccaggtcatcccgatgctcatcgtggcggccctgtggtacctcgcgatcgtgtcggtgctctccaccgcccagttccttgtcgaacgccgcttcgggcgcggcgtcaccaccaccaaccgggggatcacgcgatgaccactgtcaccgaggcaccgcccgccgtgcgggccgagggcatcgtcaagcggtacggcgccgtcgacgtgctcaagggcgtcgatctcacggtcgccccgggcgaggtgtgctgtctgctcggcccgtccggctccggcaagtcgaccctgctgcgctgcatcaatcacctggagaccatcgacggcggccggatgtgggtcggcggtcacctggtcggctaccgccagcagggtgaccggctgcacgaactgcggccggcggagatcgcggaccggcgccgtggcatcggcatggtcttccagcgcttcaacctgttcccgcacctgaccgcgctcggcaacatcgtcgaggcgccgatccacgtgcgcgggcaccgccgcgccgaggcccggacccgcgcgctggagctactcgaccgtgtgggcctggccgaccgggcacaggcctaccccgcggagctctccggcggccagcagcagcgcgtcgcgatcgcccgcgccctggcgatggacccgcagctgatgctcttcgacgagcccacctccgcgctcgacccggaactcgtcggcgaggtgctggccgtgatgcgcggcctggccgcggacggcatgacgatgatcgtggtgacccacgagatcggtttcgcccgtgaggtcgccgaccgcatcgtgctgctcgacggcggcaccgtcgtcgagtccggcacccccgccgacctgctgggcagcccccgccacgaacgcacccgcgccttcctgtcgagaatccggtgaccgtgacccctcccgaccccggttatctgcagcgcctggagaccctggtcaacatcgactccggctcccgtcacctcgccgggctgtccgcggtcaccggcctgctcgccggctggtgcgagcaggccgggatgacgaccacccggcatccggtcgacgtcgccggcgacccgcacggtgacgtgctcgtcgcccggatccgcggcaccggcacggggcggatcctgctcgccgggcacctggacaccgtcttcccgcccggcgaggcggcccggcgcccgttcgcgatccgcggtgaccgcgcctacgggcccggcgtcgccgacgaccggggcggcctgctcgccggcctggccgcggtgcaggccctgcagcgggaccggcggcacaccttcgccgagatcgtctacgtcgccaccccggacgaggagatcggctcacccgccagccgggccctgctcgccgagctcgccggcgcctgcgatgtcgcgctctgcctggaatgcgcccgggagaacggcgatctggtcaacgcgcgcaagggcatgaccgacattcagatcaccctgtacgggcgggcggcccacgccggcatcgaaccgcaccggggtgccaacgccgcgctcgccgccgcccggctcaccgtcgccctgcagcgcctgaacaacaccgggcgggacgtgacggtcaacgtcggtgtgctgcgggccggcgaacggcccaatgtgatcgccgaccgcgccgacatgctcgtcgacgtccgcgcctcggacgacgacaccttccgccggacgctgcgccagatcgaggatctggcccgggcccggtacgtcgagggggtcagcgcgtcggtcgccttcatcgcgcccaccccgccctggcacggcaccgacgcggcgctgctcgacgcggcccgcgccgcgggtgccgcgaccggggtgccggtgtccttcaccggcaccggcggatgcgccgacgccaacctcatcgcgggcgcgggcatcccggtgctcgacgggctcgggccggtcggcggcgacgaccacagcaccgacgaatggatcgatctcgactcggtgcggccacggatcgccctgttggccgaactcatcgccaccgttcccaccgggcggtccgcggactccccgtcccgggccgggctccatgggcatccggtgcgctgacgccggccaccaccacccggaacccggcgggctccggccacccgggccgtcggtggtgatcggccggagccggggacggtacgatgccgtcgtcatctcgacgccgggcggaggtcgcacgttgagcgacgccgacccggcgatgcgtgaccggcccgccgcgcgggagccggcggcggcagcgcgcgccgcgcagatccgggccgagcgccggttccggtcgctggtcgaggccaccgacacggtcgtctgggcacacgatgcgtccggggcgatcaccgaggagcagccggccctggccggctacaccgggcagccgtggccggagcaccgcgagaccggctggctggcgatgatccatcccgaggaccgggaccgggtcgccggggaccttcgcgggctgcccggccggaccgccccgctcgaacagcggtatcggctgtggcgtgccggcgaccaggcctaccggcatgtggtgggccgggcggccgcgatccaggacgagcacggcgtggtggtggagtggctcggcgccatcacggacgtccacagtcaggtggaggccggcgtcgcggtccgccgcaccaccgcgatcatcgacgccatcctgcaggaggcgccggtcgggatcggctgggccgacctggacctgcggctgcggcacatcaatccggccctggcccggatcaacggcctgccggccggggaccacctcggacggcgtccctcgcagctctggggcgagaccggccggcggatcgaggagctgatgcgcagggtgatggtggacgggccggtcaccggggtcgagttcaccgcgccggagccggagtcggcactcgtgcggcaccgggtggccagctacttcccgatccgcatcccgggctccgaccaggacgtcggcgtgggtttcaccatcgtcgacgtcaccgaacggacccgcctgctgcaggctctcggcgagcagcggacccggttcgagcggctgctgaccaccgacgtgctggccgtcttcggcggggtcgacgaggcgatcctcgaggccaacgacgcgttcctgagcatgctcgggtacacccgcgacgacctggagcaggggcggctgcgctggcccgacctcaccccgcccgagtgggcggaggccgaccgccggtccctggccgagctggccgccaccgggcgcagcagcgcgttcccgaaggagtaccggcacgccgacggccaccgggtgccggtgctgatcggggtggtcgcgctggaccgggcgccgctgcgctggctggcctacgccgccgacctgaccgccgagcgctccgcccaggccgagtcgcggctgttccgggccctggtggaacgctccggtgacctgatcgcggtggcccgcatcgacggctcggtgcgctacgtcaacccggccggcctgcggatgaccgatcgcaccgcggcgcccgagcggctcaccgacctcatcggtgagccgctgcagccgcgggagaccgcccgggaaccacgccggcacaccgcccgggcgctgcccaccggccggggcggtgctccgctcgaggtggatctgcaggcgttcacggtcgccggggacaccgagaccacgccgtacctggccgtcgtggcccgggacatgaccgaccggcagcgcaccctccggcaggccgaggggctggcccggttcgccggggcgctgagcacggcgacggaccgggcggcggtcaccgcgacggtggaggggctgctgcccgccgtcgtcgaggcggcctcggccacctggatcccggccagcgacccggccggtgcgccggacgacgccgcggcgttcgtcatgccggtgccgctggaggcgggcaccgtcgccggctccgtgctgatccgctgggaccggccggtcgagatcgacgagctgcgcaacgtgctgcagaccgtcgccggtctcagcggtcaggcgctgcagcgggccgagctgatcacggccgcctccgggatggccacgctcgccgcccggctcagcgtcacccgcaccccggacgaggcgatcgcggtgatgctggagacgattcccgccgccctcgacaccacgctgtgcggtctgctggtccgggagcagggtgaccggttgcggatgtgtcaccgcgacctgccggcggcgctggccgccgcgtacaccggcctgcgcctcgacgatccgcagccgatcgtggaggcgatccggaccggccgccgcatcgtgctacccggccgggaggcgtaccgcgaccggtttccggccgtggccgacatcgtcgccggtcacggcatcgtcagcacggtcgccctgccgctgcacgactcgcagggccgcacggtcgccgcgctgggactgggctggccgtatcggcggccgttcggcaccgacggcctggcccggctcgacacggtcgccgacctgtgtgagcagaccctggaacgaacccgcctggtcgccaccgaacaccagctcatcacgcggctcgccacgcgcctgcaccccgcttcggcggtggtgccggcggagctcgacatcgccgtacgctatcggccggcgctctccggcctggaactcggcggcgactggtacgacctgatcaacctgcccgagggacgcttcgccgtggtggtcggcgacgtggtcggccaccacatcgacgcggcggccgacatggcgcagctccgcaccgtgatcaacacgctgatccggctggaggtgccgctggaggagttgttcgcccggttcaccacgctggtcggacgcgacttctggggcaccgccgtggttctcgtcctggacccggcacgccagcgggccgacatcgtccgggccggccatccgcaccccgtcctgctcggcccggagcacccgccgacggcggtggcgaccgatcgcacaccgcccctgggactggtcaaccgcggtattccggtcacctcggtgccgttcgtgcccggggccgccctgctggcctacaccgacgggctcgtcgagcggcggcacagcgactacgaccgtggtgtcgacgacctgcacgccgtgctcgccggcacggctgccgacgcgtgcgccgacgacgtcgccgacgccgtactggccgcggcccgcgccagcgaggacgaccaggccctggtcgtcgttcggcaccgtccgccgcaccgcaccgacggggtcgacgtccgggtgccgttcaccggggagacgatcggcggcctgcggcacaccgtccaggcggcggcgcgggccgccgggctctcccccgagcgtgtcgaggacttcaccatcgcggtgtacgagctgctcaccaacgccgtgcggcacggcgggggcggcggcgagctgaccctgcgcaccaccgcgacggcgttggtgtgcgaggtccacaacgacgcgacgaccggcggcgacgtccgggtcgggccggtggcgcccgcgccggactcccagggcggccgtggtctctggctggccagccggctcgccgacgagctcgacctgcggctgacccggtccggcgcgctggccgccgccctggtgatgcgtctgggcacctgacctgccggggcgaagtggcggctccggacgcgggaacgtgctgttcttatcgggtgacgaatcatgacaagccgggagacccgagcgctgccgtgctgcgctggtatctcggtcttggcgtcatcgtcgtcgccgcgatcctgctggcgccggtgcacctgctgatgtggctgtacatggcggtggccgtcggggtcctgtccgcgctggtcaccggcatccaccgctaccggccggtctggtcgcggccctggtggctgctggtcggcacggtgggcgtctcggtgctggccaacactgtctgggcgctgatgatgaccccggccggcataccccggtttccgtctctcggtgacctctgctacctggtggcgatggggctcctggtcagcagcgtgtactgctgggtaccggggcgctcccgggacgggctgatcgacaccgcgatcgcgctgaccggcggcggcgcggtggtctgggcgctcgtcgtgacaccgctgctgtccagcgggcgcttcggcggactgcggctggccagctacctcctctacctcgggatcgacctgctgatcctggcactgaccgtgcgggtggtcgtggtgtcgcgggtgcgcaccgcggcgtaccggctgatggtcggcgcggcgacgctgtgggccaccaccgacatcacctactacgccgtcctgttccaccggccgtcggcgccgccgggctggatccaggtcggctgggtctcgacgtatctgctgatcggcgcggcggcgctgcatccgtcgatggcgcgcagcaccggcagcatgccgcgcaacgccacgccgttgtcctggctcaggctgtcgacctacgtcgtgctgaccgtgctcgtggccgggctcggcatcctcggcacggcgagcgcggcaccggccggcacggcgtggcggctggtcgtgccgctgttcctcggctgcgctacgtccgtgctgctgatcggccggctggcgcagctgggcgccgccctgaaccagcgggcctacctggatccgctgaccgggctcggcaaccgggcggctctgcagggtgcgctcgagcgccgcggcaccgacgaccgggtgctgctcgtgctggacctcgacgggttccgcgacatcaacgccgccttcgggcacaaggccggcgacgccgtgctggtggaggccggccaccggctgcgggccgcggcaccgagcgacgccctggtggcccggctcgacgccgattccttcgcggtgctcgccgacggcgccgacggggtgctgcaccggctggccgaacgcctccgggcggcggtcgccgcgccgtatccggtgccggggctgcaccatcgccgggtccgggccagcgtcggcgccgtcgtggtcggcgccggtcaggacggcacgaccgcgctgcgcgacgccgacctggccctgcagaacgcccgggcgcagggcgacggcctggcgctgttcaaccccgcggagtacgcccagtggcgcgccaaccgcgacctgatcgccgatctgcagcacgccctcggcgcggacgagttcgccatgcactaccagccgatcgtcgaactcgccacgggccggatcatcgccgccgaggccctgctgcgctggacccgggccgacggaacgccggtctcccccggccggttcatcccgctggccgagcagagcggcgacatcatcgtcctgggcgagtgggtgctcgcccgggtctgcgccgacctggcgggcctctggaccgacttccagctgccggtgacggtgaacgtgtcggcacatcagctgcgcgacaccgggttcgccgcccgcctgctgaccctgctggccgacaccgccctgcccggcgcggcactgatcgtcgagatcaccgagaccgtgctggtgaccaccgtcaccgacgccgccaccaccatcacgcagctgcagcagttgcgcgaccgcggggtccggatcgccatcgacgacttcggcaccggttactcgtcgctggcgtacctgcgggagctgccggtggacatcctgaagatggacggctccttcacctcgcagcagatcgcggacggcggcccgcgggagatcgcattcgtgcgcaccatcgtggatctgggccgcagcctggacctgagcacgctggccgaggcggtcgagacgcaggcccaggcggaccgcctgcgtgagctgggctgcgacctcgcccagggctaccacttcgcccgcccggcacccgtcggccggctgcacgagctgctcgccgcgcagcgctgcgggatctccgacacggcggcctgaggcggcagccctggagttcggccggctcgaggccgggctcttccagatgatggtcggcccgtacaacgacgtacttggtcgtgcagcggagctggttccggccgcgctggagaaccgcgcggaagcagcgtcggcggcccgcgaggcacatacgctgaggcacgagaggagacaaccatgcgcacacgcgtcgaccagatcagcgaccggatctaccgaatctccacgtgcatcccggatatcgccccaggaggattcaccttcaaccaattcctggtcgatgccgaggagccgctgctgtatcacaccggcatgcgtcaacttttcccgctggtgaaggaggcgattgaacggatcatgccggtggagcgcctgcgctggatctccttcgcgcacgtcgaggccgatgagtgtggcgcggtcaacaacttcctcgccgtcgctccgcatgcacaggtcgtccacggcgatctcggctgccaggtttcgctcaacgacctctgcgaccgagatccccggccgctggcggatggagagaccctcgacatcggcggcgccacactgcaacggcgcctgatcgcgctacccacgccgcacgtaccgcacaactgggagtcgcacatgctgttcgagcaggagactcgcacactgttcctcggcgacctatgcacccagttcggcgacgggccgcccgtgacggaccaggctccgttcgaagcgatcatcgccgccgaggacctcttccaccagacatcgctaggcccggcggtgctgacaacctaccggcgccttgccgaccttgagcccgtcactctcgcagtgatgcacggttcgtcctacaccggggactgcccaaccctgctcaggatgatcgcggacatctaccaggagcgctacggatgcgggacaccgctgctgggtcagccgctaccggcgcacaagcttgtcggttcagattgagtcggtgtttcagttgactgtggccggtagcatcgccttcggtcacatcattccgcggtacctctgaagcgtagccgcggagcgcgcgcgctctgtcgtattgccctcgcgcagcggtagacgccgcagtacggtccgcacgtggacagcacccagctgcgtgtcgaccggatcgacgtttggcagaccgatagagagcacacgctgagccttgctgctgcgggcgtccacgtgatgctggtccggctgcgctatgacggctgggtggacgaggtgatcaacggcgctgggacggttgcgccagggccaggcgcgtggactctcatcggccgacggttgaccctggagttcgacccacgggccgcatcggccctcggcttccaccgcgactgccagctgtatctggatgtggacgcggacggaatccggcgtgtcagggccgcgctgttggaaattctcgactgcgcgtgtttcgtggtcgacaccgacgaaggccgcttgaccagctgatactcggtcactagtcaaatccgtggtgagacgccatcaccctcagctcttatccgttaaccctggccgtggtgaactggccggatcacaagcgggttgccgccgcgcggctcaccatcgacaggaagccggttcggtcttgggagatggcgctccgaccgggccaggattcggcagcgctcaagccgggcggggcgtgctagcgggcgacggccaggcttcgtgcgacggcgcgcacggtgggtgccagcgcgtcggcgatcaccgcgtagccggcgctcgacgggtggaaccggtcggcgctgaacaggccggggtcggcggcgaacccggcggccgagctgatcccgatgccggtcacgtgcgcccccgccgcccgcgcggcgccggcctgcgcgtcgtgcagcagggtgctggcggcccggaccgcggggcgcatctcggccggcagccgcgggaccacgctcaggtcgggcgcgggcgccacgaccacctcggcgccgaccgcccgcagcccgcgcaccgcggcctccagctgcgcggccgcctccggcgcggggaccagatgggtcaggtcgttggctcccacgatgatcagcgccaggtcgggcggccaggcaaccgccgcggtgagctgcgcggtcaggccggcgctgcgcgcccccggcacggcgaagttccgggtctggtgcgccagcccggccgcggtcaggtcggcggacaggcgggcggcgacggtgtcggccgcccgcgacgccccctgaccgtaggcgatcgaatccccgagaaccgcgaagttgataaccacgtgatgtgcaacagcggtccccccgaacatgtttccgggtcgctcaggcgatgtcgatcgcgtccagctcggcatagttggtgcccttgccgtacgccacggtgttggtcccggcccggagcgtcacctcccgctcgctggtctgccagttgtcccagccggtgaccggatagtccacggtcccggccgcggccccgttgacggtcagggtgtggctggcggcgccggcgtccgagccgttggcgtaccgggtgtacaggcggtaggtgccggcccggggcacgcggacggtgaaggtgacccggctgtcggcgaagtcgatgccaccgaccacgaccccgttgctggcgcccccgacggcgtaccgggcgttcgcccgggtgaagtcggcgtcctcggcctcatagcggatcttggcaccggccacgaccgggcggtcgcccagccagtcgagccgttgggaatacaccgcgcggtaggtgaacgtcgcgtcccagccgtggaagaggatccggtcgtgaccgtcggggccggtcgcgacgacctggccgccggggccgcgcaccgagccggcgaacgcgtcggtggtcatcagcggcgcctcggccttggtgtacggcccgcccaggctggtcgaggtggcgtagctgctcacgtagctgccgttgccgaagaagttggccgagtagaacagtacgtacgtcttgccgtgcttccacagtgtcggagcctccaccagggtgccctcgaacggcttgttctgcttgatcagccgggtttcggtgccgatccggcgcagcccgtccgcgctgacctgctggagatgcagccaggtgtcctgcgcgcagcagttgccgtcgttcttccacaggatgtaccggcgaccgttctcgctgtacgaggaggcgtcgatcgcgccgccgatctccggggtgcagaccagcgcggcgtcgcggggcacgaagggtccgcccggcgacgtcgcggtcgcggccccgatgcactgctttccggacgtacggtcatgagcggtgtaccacatgacgaagctcttcggtccggcggcgaagacctccggcgcccacacgccgtgatcacccgcgccgccgggcgggaacgtccaggtcgggtccgcccaggcgcccagcgcgggcagggcgtcgccggcctgcacggtccagccgaccaggtcggtggaggtggcccacctgatgttccggccgtcgctgttggtggcgtaggcgtagtaggtgtggccggccttcatcacgtccggatcggcgaagttctcgtcgatgaccggcccggccacgtcggcgctcggcgcggccgccgtcggggacgatgtcgcggccagggtcggggcgggtgccgcggtggcggcggtgagcaggccggcggccaggagcagggcgccgcgtgggatgcgggacacgatcacaggtcctccagtgaggtcggtggatcactgccggagatgctcgtaaattaacgtctccgcgccctgctcgcccgccgggcggttatccgcggtcggccacgatcgcgtccacggcgggcatcgacgaccagtcggaggaggcgacactggcatgcgcggcggcgacctgcgccacccgggccttcgccgcggcggtgtcgccggcggtgaccaccggggcgatgttttgcacgtcggtcatcaccagcagatagtggttggtgtcgtaccaggcggtgtcgatgccgccggtcacgtaggtgttcgcgtcaccgtcgaaggtgacgaaccacgggcgcagcgaggtgtccgggtagcgggtgcgcgggtcgcccttggccgcgttgtgcaccgccgggaagatctgcgcccggctcagcgtgccggccgccttcagcgaggccagatacctcgcgtactcggtgtcggtccacagcgtgtcggtcgggttgccctcctcgacggtgcccgggatcacctcgatgatcaccttaccggccagctgggcccgggtcggccaggcgttcgccttcgcggcggcgtccagcgacgcgtacgagccgagcaggtcggcgggcttgaacacggccgcgcccaggtgcgccgcgatcgccgcgtccagctgcgccggcccctggccggtgcgaccgctgaagccggtcttcaactccagtttcagcacgagcgggccggcgtccgggtgcgcggcgagccacagccggatgtcgtcgaggcagtactccaggttcttgttggcgcggccggagtacagcccggacgcgctggtcgccgccacgcagttgttggcgttgccgagcgggttgctgtggctgaccttccactcccgggtgatcacgtcgggccagacgtccagctcgatcaggccgggccgctggtccagcgcctgcgcgaggtaggcgaaggtggccgggtcgtacgtattgtggatgccgaccgtggtggtctgcgaaaccttgctgcccgatccggcggcctgcgccggggtgccggtcaccgcgacggcggcgaccagcccggtgaccgccgcgaccccgcgcttgaggtgagtgcgcacgtgtgatcctccgttttgccggccggcgccacgccgaccgctcggagtcatatcaatcgaaaatcatgaacatgtccatgcctgccgccgaccctcgggcgaacagagcacgacctcgggcctttcggccgaccgcggtgcggccgcggacgccggggcgcagatgtcgggtgaccgcctggaagccgtccaggtcgatcaccgggatcccggtgagtcgcctgcgccggcccgcgaaagatcagacctcggggtgagcgtcgtgctgatagacgtccggaacgccgtcggcgtcggtgtccaccgcctcggccgcgcagagccggcggtagtgtcgattgcggagccgcaggaccacggacgccagcagcgccgcggtcaccgagccggccaggatgccgatccgggcgtgctcgccggtcacgctgccggcgccgaaggccaactcgccgatcagcagcgacaccgtgaaaccgatgccggccagcagcgccagaccgaacacgtcccaccagctcaccccgtcgtcgagactggcgcgggtggtccgctgcaccagccaggtggcgccgaacaccccggcgcacttgccggcgatcaggccggcggcgatccccagagtcaccgggtcgcgcagggtggcgccgagcccgccggcgccggccagcgggaccccggccgcgaagaacgcgaacagcggcaccgccaccccggccgacagcggccgccaccggtgctcgaaatgctcggccaggcccgggccgggcccctgcgcgcggcgcacgaccggaaccgcgaagccgagcagcaccccggcgacggtggcgtgcaccccggaggcgtgcaccagcacccaggtggccgcggccagcggcagcagcagccaccacgcccgcacccggcgctgcaccagcaccgcgaaaccggccagcggcagcagcgcggccagcagcggcagcggatgcagggcgtcggtgtagaagaccgcgatgatgacgatcgccagcaggtcgtccaccacggcgagggtcagcaggaaggtgcgcagcgccgccggcaggtgggtggcgatcaccccgaggacggccagcgcgaacgcgatgtcggtggcggtcggcaccgcccacccggacggcaccccgccggcggcggtgacgttgaccgccgtgtagatcagcgccggcgccgccatcccgcccagcgcggccgccaccggcagcgccgcccggcgcgggtcccgcaggtcaccggcgacgaattcgcgtttcagctccaggccggcgacgaagaagaagatcgccagcagaccgtcggacgcccactgtgcgagggtcagatccaggtgcagcgccggcaccgcggcccgggccgcgaccagcgcctgataggcggccgaccacggcgagttcgcccagatcagggcgatgaccgcggcgcacagcagcagtgccccgccgacggtctcggcgcgcaggatgtctccgatccggctgacctcgggccagctgccgcggccgaacaggggacgacgcgggcgggacggcggtgcggacacggagctcctcgggaagcgggcacggcggacagtcgccgaccagacttcccggcacacctgaactgaaccttaccccgcgacgacggccggcacggcgggcgccgtgccggccgggtgcggcggggctcagcgccggcggcggcgcaggagcagcacgatcacgccgagcagggcggccgcggcgatgacggccggcgggaccgcacggcgggtcgccgggctggtctgctcgaccacggtgctcttcgcctcggcgatccggtccttcgccgtaccggcgatctcggtgctcttggccttgacggtctcgaccgtgtcggcggccttgaccttggcggtcccgaccgtctcggcggccttgaccttggcggtctcgaccgtgtcggcggccttgaccttggcggtctcgaccgtctccgcggccttggccttggcggtctcgaccttctccctggcggcctgcttggcgcggcccttcacgtcggtcttcgcgaccagcgcctcgaccgtggcgcccaggtcggcgcgggtctgctggatctcctcccgcaggtcgtcgggatcggcgggaacgtcaggcctggtcatagtggttccgtcctcgctgggctgcggtcttcacggtcttgacgtcggcctcgacactgtcgatcgcggccttgggggccagcggcgtcgcctcggccagcttcttcttgccgagcagcgcggcgacgccggccgcggcgaagacgacgaccgcgacgatcagcaccgacagccacagcggcaggaccaggtcgagcaggacgacggcgagggtcagcagcaggccgagcccgtacagggccagcacgccggcgccgccgaagagcccgccgccgacaccggcgcgcttacccttctcggtcagttccgccctggccagggccagctcgtcgcgaaccagcgtggagatctgcgcggccgcctggctgaccaggtcggctgtggacgccgtgcccggcgtcccggtacgcaatgagtcgctcatcgcggtgttcacctccttggtgcgtcaccgagaggtgtgcccgcggacccgccggacgaaacggcgatcaccctcctacccttcgtaggtgaatgggagagatcgaccgctgtgccggtttgttcgatgcgctcatgcactgatcggaatcgttgcggatctcccccgactcctgaagatttcccaggtgaatgtgtcctatggggaggttcaggcagtgtcgcctcgacaacgcaagcttttgatctccagcgtggcgctggtcaccgtggtcgggttgatcccgtccggtgccgcggccgcgcccggtggccaaccacggcccgagccgtaccagcgtcacgtgcaggccgcccagcagcgggccgcgctgcacgccgggttcagctcccgatccgccaaggccgacgaggacgagggcgaggacccggaggagatcgccgaacaggccgagcagtacgccgaggcgcgatccgctccgggcatcgtcgccccgggcgcctacaccgccgcctggcagcagctgcggtcgctgaagtcgaccgggggcacctggcagcaggtcaccgaccggccgtacaactccgacgacccccgctaccgcgacgtcaacagcaactcctccggcggcgccggcttcgtcaccggccgggtcaccggcctggccgccgacgaccacggcttcgtgtacgccggcgcggccaacggcggcgtctggcggtcccgcaccggcggcggccactggcagccgatcgccgagcgggtcccgtccccgtcgaccggcgatctgcggctggaccgctccggccggctgtggtgggccaccggcgagggcaacaccagcgccacctcgttcgtcggcagcggtgtctacgtgctgagccacccccggaccggccgcttcaccacccgggaccgggtgggtggcaccgagctggagagcacgatcatccgcaagctgcggatcttcggcgacaccgcgtgggtggcgacgaaccgcggggcgttcagccactcgatcaagaagctgtccgggccgtggaagcaggagttcgtgccgaacccggacttcctgcccggcggcgcgcaggcgggcgacgccaacgccccgtacaagaacattgtcaacgacttcgccgccgacccgaaagacccgtcgaaggtggtcatcgcggccgggtggcgcagcggcgacacgtacaacggcttctacacccgcgtcggcggcgtctggcagcggaccacgctggccggcgacatcgcctcggacgcggcgaacgtgggcacggtgaccttcgcggcggccgcggacggctcccggtactacgccatcgaggagtcgccgacccagctgaccaccaacccggacagcgcgctgcagggcatctacgtgtccgcgtccggctcgccgttcgggccgtggacgctgtcggcggactaccacaagctggccgcgtccggctcggcgctgaccgatcccggctacatgcccggcatccaggcctggtacaaccagttcctgcaggtcgacccgaccgacgccaaccacgtgtacctgggcctcgaagaggtcttcgagaccaccgacggcggggcgaactggaccgtgcccggcccgtactggaacttcggcttcccctgctggtcgatcgacccgggcaagcagaccggtgactgccaccagacggtgcacgccgaccagcactcggtgacgatcggatcgaaccacggcaggacgtacgtggtggtcggcgacgacggcggcaccttccgccggcccgtccgcggcgccgccgacgccgccgggcacgccaccgactggaccccgctcaacgacggctcgatggacgtgctgcagtactactcggtgggcgtcgggcgcgacggcaagggcctcgcggtctccggcggcctgcaggacaacggccagtccatcctgcgccccggcgaccgggcgatgggctccaacttcggcggcgacggcggggacaccatcgtcgacccgggcaacggctgcaacatcgccgaggagtacgtctacctcgacgtgtgggtgaccaacaactgcgcggtcaacgacggcgcctggaccaccgaccgcagcaaggccaccagctacgaggtcgcaccgccggacaacaagaccggtgaggcgcgcttcatcgccccgctcaaccaggacccgcgcgacgccacggtctgggtcgccggcggccggcacgtctggctcaacaccaagggctacgcgatccgttccggtgccgagtggaccaacctgttcgacctgggcgccgggcacaccgccacggccgtgtccacctcgggcggcctggtctacgccggttggtgcggtccgtgcaacaaccagggcttcacccgcggcatcgcggtcgggcacaccgacggcaccggctggcaccagctcgccctgcccgacctgcccaaccgatacgtctccggtttcgacgtcgacccggcgaacccgaaccacgtggtcgtcgcgatcaacggcttctcccggcgctggaccgagggccccggcgcgggcatcggccacgtcttcgagtcgaccgacgccggcgaacactggaccgacatctccggcaacctgccggacatcccggccgacgcggtcaaactggtccgcggcggcgggctcgtcgcggccaccgacaacgccgtcttctaccggcccgcgcacgcgcggtcctggctggtgctcggccgcaacctgccgaccacggcgacgctcgaactgcgcaccgacccgaccgggcgcacgctgtacgcggccacgcacggccgcggcatctggtcgtacgacgtgagcaagcttccgcgctcgcgctgacggcacggccgcgcggtgggacccgtctcctatcgggtcccaccgcgccgccctgtcatgcgaggacaccggcccgcgagagccgccgcgcctgattccggcacccgacagtcgcggcggatcctcaagacgccggcgccgggcccgatggtggggccatgagcaacgatccgccgcagctgctggacgcctccctgacccatggcgacgccggggcagctaccggcgggtcgtcgccggcgggctggtacgccgaccccggcggcacgtccacgttccggtggtgggacgggcagcagtggaccggcttcgtccagccggcgccgcccgcgccgccggtcgtggaaccggcgatcggcgagccggtggtcgcggccgggacggcatcccccgccagccgcggacgaagcccccgccgagccaccgtggtcgtcgcggcgatcggtgcggcggttctggtggccggtggcgccatcgcggccgtagtcaactcgtcggccgagtccgagctctgcggcctgatcggtgaccggcagtcgttcgcccgcgccgccggggatgacgctgacgacgtgggcagggtcgcggcggtggccgagcggatccacacgctcgccgggcgactcgtcttctcccgcgacctcaaggatgcgggcgcgggcttcgccgatgccgtgcagaccatggtcgccctgcgccgcgccggcttcgatgacaccgcgacagccggttccgccaccaccgcgcggatggcggagacagcggtgtccgccgtcgagaatctgagccggatgcagcgatcctgcgggctcccggtcaccgggcagctcgccgctgacacgggcgcctcagccgagaccgccgaccgggcggcccagtcggacgtgcgcggcgccatcgccgccgtcgaggaggcctacaccgagatgggcaacacctacccggacaccgcgatcgccggcgacaacagctctggcggcacgccccaggtggcggtcggctcgtcgacggagaagatcacgctgtccgacaagacgaagctgtactacgtccccacctctgccgacacctacaggatctgcgcgacgaacgtcggcggcagcggcaagtggtaccgctacgactcgtcacagggcgggtctgtcggcgccgtcagcccgcccgccgacccggcgagctgcgcctgagggatcgctccggttcagtcgccacgcccggtgtcggtggtgctgaagccgccggtccaggcggccttcgcgcccgagtcgccgatccggtacatgccgtagacgccggctgccgccgcggccaccgccagcacggtcacgatcccggtgacggccgccgagcgcggcgcaaggaacgcccggccgcccggcgtggcggtggcctcccggtgccgccaccagacgagcacggcgaggaccgcgatcggcagcgcgtagaagatcgccgagtcgccgagttcggcgtgccggtggaccaggtcgctgcgcggcacccgctgttccagccactcccccgcgctggtggtcagcggagtgagcagcacgaccacccacgccaggacgacgttgaacagggccagccgggcgcgggcggccggccacagcgcggtcagggcgagcagcagggcgctcagcgggagcagggcgacgaccgcgtgcacgagcaggatgtgcgcgggtagtccgttgacggagcgcggggcgcggccggtgacgttggcggtgcgggacgacggcaccggcttcgccccggcggacgccggacggctgttcgaccggttcgcccgcggtcacggcgaccagcgccggttcgggctcgggctggcgctggcccgggaggtggtcaccgggcacggcggcgtcatcgaggcggtcggcgagccgggccgcggggcggtcttcacggtccggctgcccgccgcgcggacccgatcggattagcccggccggtcggccgcctgcgggcgactgacctgcgccttcccggtcggcatcatcggcggcatgagcgtgtgcgcagggcccgccgacaccggagccggccggccgtgacggcggtggcgatgctggccgcactggtcgcggccggcggttggggcttctccgatttcctggccggggtgctggcccgccggatcccggtgttgaccgtcctgatcggttcgcagatcgccgccatgctggtggtgctgcccgccgcggccgtgcacgagcgtccggcggcctgggacggccggctctggctgggggtggcggccggcctggtcgggttgccggcgatgggcctgctgtaccgggcgatgcgggacggttcaccggccgtggtggcgccggtcgccacggtcgccgcgatggtcccggtcggctgggggctgcggcacggccccggggtcggcacggtgacctggctggctagctagctagggcgtctatttcgtcctgttgcacgaggccggtgcggcggacccgttctgggcgctcgcgggtgcccgggtgagcggcggcgcgggggcgctgctgctggcgctcggcctgcgggagcgacacactgtccgattccggtcacccatcctgctggtcggtctcgccgacgtcgtcgcggacggggcgttcctcgtggccgcggccgcggcgctggccccggcagcggtggtgacctcgctctacccggcggtcaccctgctgctgaaccggtggttcctgcgggaacgtctgcacgcggtgcagctgtacggcgtcgtcgccgcgctgttctcggtggcgtgcctggctcggtgacggggacgagaacgatcaatgaatcgtgttaccttccagctctttacggggggatacgatgcaaccgtccaataccgcaccaccggcccgccgcggcgggctggccgccgcgctgcgcacctgggtgcccacgatggtgttcaacctggtgctgccgctgatcacctatcaggtgctgaccggccacggcgccggtgaggtgaccgcgctgctggccagcggcgtgtggccggtgctggagacggtggtgctgctcgcgatccgccgcacctgggacgagttcagcatcttcacgctgatccttctgctgctcggagtggtgtcggcgctcggtttcaacagtccgcggctgatcctggtcaaggagtcggcgatcaccggcctgttcggcgtggccctgctggtctcgctgctggcgccgcggccgctgatgttctacttcgggcgcaagttcgccaccgacggcaccccggagtcgatcgcctggtggaacgggatgtggcagttccccgggttccggcacagccagcgcctgatcaccatcgtctggggcatcaccatgctgtccgaggcgctgatccggatcgccctggcctacgtgctgtccaccggcacgatgctggtggtgtccagcatcctgccgtacgtggtgttcggcggcctggtcttctggaccgtcacctacggccggcgtcaggggcgtcgcgccgccgcccgccaggccgaagaggccgcccgccaggccgaggcgaaccccgcgtgaggccggcccggctcagtacgcataggtattgagctgtgccaccgcgccggccgccgcacccaggtcgtaccggtcgacggccaggaagttgggcttcttgcgggcggccggtgcgcagaaccgctcggcccggttgagcgccttggcgttgtcaccggccgcggtggccgccatgggcacgtcccggaagtggttcatgacgaacagcgggcggaacccgggcgcggtcgcggtgagcgggatgccggccgggccggcaccgggccagcggctgtaacaggaccagtccgaggcgcccgctccggagcccatcgaccagtagttctcgacggtccactcccgctggtactgcactccgaagctgtcccgggtcaggccggccgcctggtccgcagcccggtcgtggtcggtgaagatcagcaggcggtggttggtccggcgcagctcggccagggtcggccagccccgctcccggacaccgtcgaggtcggggcgcaggagcatggcgggcagcgcgggcacccgggccagctcggcgcgcagcacgccggggtccacatagtcctccaggaagacggtggccacctcgtccggatgcgcggtgaggaagtcggtgatccgtttgaggtcgacccacagcgcgaccggacgggacaccagcgtgcagctgtcgtggcagaggatcgcaccgtccggcgtctggtgcacgtcgagcatgaaaccgcgtacgccgtcggcgagctgccggtcgataccgcgtacctgattggggaagaggttgatgatcggcggcgcgaaaccaccgtcggcgccgttggcgtacgcgttgtgcgcggtgaggaaggtgacctggtccagcgtccgatccggctcggccggcagcgcggcgcgcaccggggtcaacggcgtcagataccagtgggcctgcggcccggcggcgtccagcccgagctggtcggcccagccggcaccgccgggcaccaggctcaggtagcgctccgcgccggggtccctgaccagatactgatcgtcgccggcgccggtgatctgccaccgggtgttcgcatccgcgcacggcagcatggccggagccgtcgccgtgcggcccaggcagcgccccggcccgtcgatgctctccagccgccaggcgtcgccgtcggcccgcagggtccactgctggtggtcctcgtcgcccttgggccgatgctgcgcgagcgtgtcaccggtcgccgcggcggcaaagccggtgatgacgctctgcaggtagtagccgcccggtgccggtgccggtgccgcggcgacgggcacggccgaggcggggccggcggccaggatcggcaccgtccagacgatcgcggatagtgggcgcatgccgggtcccctttgacacgagcatctaaaatattgatgtacgtctataccctacgacccctgcatggcaagaccccggcgcaggatcgtctcggccacgccggccgcccgggtccggtcggccggcaccagcccgatcctggtccgccgatccagcaggtccgcggcgtccagggcaccctcggcgcgcaccccccacagcagctcggccccggtcaccgcgatcccctcggcgaccggctcggccagacccggatcctcgatggccagggcggcgaccgcggtggcctcggcgccgtatcgcgcgaccagccggcgcggcgcgccgctcccggccagccgctccggcgacgcggcaccgaccaggggcagtcccgccgtgcggcagcgcccggcgggcagacccgcggaccgcagggcggcatcgacggcgtcccgggccatccgccggtaggtcgtcagcttgccgcccacgatcgtggtcaccccggcgggcgaggtgaccaccgcgtgccgccgcgacagatcggcggtgctgccggcaccaccggcgagcagcgggcggaggccggcgaaggcacccaccacatcggcctcggtcaacggcacgtccagcaccgtcgacaccacgtcgagcaggaagccgcgctcggccggtgtcggctccgggacgtccggcaccggaccctcgaccggctcgtcggtcagtccgaggtaggcatggccgtccgcctgcggcagcacgaacacgaaccggctggtggtgcccgggaccggcacggtcagcccggcaccgagccggcccagcacgccggggcgcagcaccaggtgggtcccgcgggaggggcgcaggctgatcgtcgggtcgagccggtcggcccagacgcccgtcgcgttgaccaccgcgcgggcgcgcagccggtggcgctcgccggtgagggtgtcgcgcaccgacgcgccgcccccggtcagctcctcgacccggcaccgggtgatcacccgcgccccgaagccggccgccgtgcgggcgagcgccaccaccagccgggcgtcgtcgacgagttggccgtcccagccgagcagaccaccccgcaggccgctgcgccggaccgcgggcaccagccggtgcacctccaccggggtgatgcgccgcgatcggggcagccgcccggccggcgtgcccgccccggcgcgcaggaggtcgccggcggccaggccgacccgggccagcccggcctgcccggcggagagcagcggcgtcaacgggatcaccgagggcagcggggtgatcaggtgcggggccacccggcgcagcaggatgtcccgttccacggcgctctcgtaggccagcccgaggtgcccaccggccaggtaccgcaggccgccgtgaaccagtttcgagctccaccgggaggtgccgaacgccaggtcgtgggcgtcgacggcggccaccgagaggcctcgcgaggcggcgtccagggcgaccccggcgccggtcacgccgaggccgacgaccagcaggtcgaccgtggccccgccggccagctcgtccagctcgcgagcgcggcgcccggcgttgagcgcggtcccggcggtcacggcgcgaggtaacggtcgaggagcaggcgcagctcggtgtccaggtccgcctcggtgacctcgtcggtcatggtggccgacgagacgacgaagccgtgcagggtgagcagcaggctgcggccgagcagggccggcgggccggtgcgcaccgagccgtcggcgtgcccggcggcgatcgtctccgccagcagtgccagcatgcggtcctggctggtgccgcgccggtccaccagatagggcagcagcacctcggggtcgagctcgaggatgcgacggaacaccgcgttgtgccgcagccgcgtcgcgccggtggtcaacccgttcaccaaccggtcgcgggtgtgccggccggccgcgccctcctgggcgcgcagtgccagctcaccccactccctggtcatcaggtcggcgaccagggacgccatgtcgggccagcggcgatacatggtcatccgggacacgccggcacgccgcgccacgtcggtcagcgtggtgcgacgcagccccacggcgagcacgcactggcgtgccgcgtcgagcagggcgtcgtcgtccgtccggctcccgggggtgttacgactggacatcatgtgtcacagtgtaacccgtgaatgagcttaccgacccggcgcggtggggcacgcccgccgccgccatgaccctctcccccaccgtgctcgacatcctcgggtccgccctcggggtgaccgggccgcggcccgccgccgagtcggtcgagctgcccgccgccggcctgtccgaagcggtgctgcgggatctgcgcgcggcgtgccccgaggtggccaccgacgacgccgcccggctgacccacgcggccggcaagtccaccgaggacctgctgcgcctgcgcgccggggtggccgccgacgccccggacgcggtggcccgcccggcgaccgaggacgaggtgaccgggctgctcgcggtctgcggacgccaccgggtcgccgtggtcccgttcggcggcggcacgtcggtggtcggcggcctcaccgcacgccgcgacggatacaccggggtgctcgcgctcgacctggcccggctggacgggctgcggcacctcgacccggtctcgcgcaccgccaccttccaggccggcatccgggcgccccgcgccgaggagctgctggccgcagcgggtttcaccctgggccacttcccccagtcgttcgagtacgcgtcgctcggcggtttcgccgccacccggtcgagcgggcaggcctccgccgggtacggccggttcgaccggatggtggtgggtctgcgcgtggccaccccgatcggtctgctcgaggccggccgcgcccccgagtcggccgccgggcccgatctgcgccagctgatgctgggctcggagggtgtgttcggggtcatcaccgaggtcaccgtccggatccatccggcgccggccgagcggcactacgagggctggagtttcgcgtcgttcgaggccggcacggcggcggtccgcgcgctcgcgcaggacggcccgctgcccaccgtgctgcggctctccgacgagaccgagaccgcgatcaacgcgatgaccggcggcccgcggggcgacggctgcctggccgtcatcggcgtcgagggtgagacgcgggacgtggcgcgacgccgcacggagctggagcggcggctcaccgagctcggcggcaccccgctgggtgcggcgcccggcgaggcgtggcgggccgggcggttccgcgcaccgtacctgcgcgacgccctgctggacgcgggggccgtcgcggagacgctggagacggcggcgttctgggaccggctgccgcagacgtacgcggcggtccgtgacgccctgatcgacacgctcgccgaggccggcacaccgccgatcgtgctgtgccacatctcgcacgtctacgacagcggagcctcgctgtacttcaccgtcgtcgccgcccaggccacggatccggtggcgcagtggcgcgcggccaagaccgccgccagcgaggccgtcgccgcctccggggcgaccatcacccaccatcacgccgtcggccgcgaccaccgcccgtggtacggccgggagatcggcgaggtgggtgccgccgcgctgcgcggcgtcaagcaggcgatcgacccggccggcatcctcaaccccggcatcctgctgccatgagccgggacgtcttcaccgcggtggtcaatccggcggccggcgcgggcaccgccgcggcccgcatcacggcggtggcccgggcgctgcgcgaggccggggcgaccgtccacgtggcctacacccggtctctgcagcacgccaccgagctcgccgcggccgccgccgagcacaccgtgctggcggtcggcggtgacgggatcgccggcgcggtcgccgccggcctgctggacaccggtgccgagctggccgtggtgccggcggggcgcggcaacgacctggcccgggccgtcgtcccgctgccggccgatccggcggcggcggcacaggcgctgctgcggacgccgagcggactcgtcgacgtggccgaggccggcgggcgggtggtggcgggcagcgtgtgcaccgggatcgacgcggtcgccaacgacctggccaaccggcggctgccccgccggccggcggcctaccagctggccgcgctgctggtcatgctgcggtggcgcccggtgcggtacacgctcaccgtcgacggggtgaccgcgtcgttcaccgggcacaccgtggtggtcgccaacgccccgtggtacggcgggggcctgcgggtcgccccgcacgcccgcctcgacgacggcctgctcgacgtggtgaccgtcggcccgctgccgcgaagccggatgatcggcgcgctggccgctctgcggcacggcaggcacctcggccttcccgggatcaccacccggacggtccgggagatcaccgtcgcggcgaaccggccgctgccggtctacgccgacggcgagttcctgggcacgggcccggtgaccatacgggtccggccggccgctctgcgactgatcggagcgggcggcgccggctgagggccaccgcccacccggtctgctgagctgtcggcggtccgcgaccgaacccggcccggtcatcgccctcgggagcggcggcgtccccgggtgtccgaacggttggtggtcacacctcccaggacggcagcggccagcgctggagccggtagggtgcccaccagacgtcaccgcagaccgggaccacgagatgctgacgttcgaacagcgcgacgatccgctccggtacggcctcgcggccccggccggccagcagcgcgtcgatggcggcgaggtggtcggggtcgctgaccgtcaatcggcgaaaaccctggtgccgacggtcgcggatctgcacgaagcccggtccgcgacgcaggaaacaccggcccaaatggtatttcgcgcgccaggccgccagcgtctcggcggcgtgcggaccgtcgagggtcgcgggtgggaacaggtggctgaacacccaccagggcgcgctgtcggcggacagctgggcgtgccacgcgacgtccatcccgtggctggtcagttcgcggacgaaggagagcgcggcgagggtgtgctcggcggacggctcgggcccgagcgcgatcgggtcggcgatcgacacgaaccgcgcgccgagccggtaggcccggctcgcctcaccggccacgtcgtcgaggaaggcgccctcgcccaggtgtgcgtgcgccgcggcgtcgcgatggcgccagcgggcgtaccggacactcgccccgttcatcgatgtcgcggacatctcgattcccctttcacacggccaccggcgccggtggccgatcggccgctcgccattgccggccggcgagaatgcgcagcagcctctggttctggtcctgggtgaccacgtggatcatgcggccggcgtcgctgaagtacaggcccaggccatcccagcgctcgaggaccgcgtcgatctcggcgacggtcgcgccggtgcgccggcccacctcccggtgcaggaacgcggcggtccgcggttggtccagcaggtcgaacagtgagcgttccaccggcgtgcccaggcgcacggtgcgccagtcgaagccggggcgggtgttggcgatcgtgatgccgtcgtcgtcggcgaagtaggacagttggctgcgccagtgctcgccgcgccaggtgtccagcccggcgctcagccgcgccgccagatcgtcgccgatgccccgctgcggcgcctcgaacaggtacgcgagatcgaacaaatccgcctgcggcaggtcatagcagagttcgtactggcgagccgggcgtcggtcggcgaagcccagctccggcttctcgaagtacgggctgaaccgctggatgccgaggcggtcgtcggcgccggccgggcagagatggtgcagcctcgggaactgctcgatgaccggaaggtagtcgtcgtcggtctcacccggaaacccgtacaggtagttccagatgacggtcaggccgagcgattcggcgtcgcgcagcatccgtacgttctggcagccggtgacgcccttgtccatgagcttgagcacgttcgtgttgaggctctccacccccggctggacgcacaccacccccgcgtcggcgagcaccttcagctggtcgtaacggaggttcgccttgatctcgtacatcatccgcaggtcgatgccggcggcggtgagccgcggcagcagcgagtccaggtaggccatgtcgaggatgttgtcgaccacgagcaggtccaggacgcggtgacgttcggcgagcgtgacgatgtcctcgaagaacttcgacggacgtttgctgcggaacgtcatgctggccccgttgagcccgcagaacgtgcagtggtgccgctcgccccaccagcagccgcgcgccccctcgatgaccagccggggctccacccaccgccgggcctgcgaggcgccgaatcgttcgaagtactcgtcgtagtgcggcagcaccatggcgtcggtggccagcggcttgcggccgggccggttgaacaccggggtcccgctgtcgtcacgccagcacaggccaccgatctccgcgatggggggcccctccccgcgcaccgaccgcagcaggtcggggaaggccagctcgccctcgccgcgtacgacgaagtcgacgaagccgaagttgcggtgcatggcctcgccctgggtgtcctcgcagttggcgccaccgaagacggtgacggtgcgcggggacagctccttgagccgccgggcgaccgcgagcgacgccgtgacggtctggaacgtggtggtgaagccgaccacgtcgggtgcgtccgccgcgatccgggcggcaaggtggtcgatgaactcgccggcgtgttcgtgcagccacagggtcgtcgccaggcgggcgcggtcgaagccgggcacgtcgtccggcgcgaacgcctcgacgaactccggcacccgccacgacgggtccgtgtacagggcggaggagaacacccagtcgccgtggccgaggtagcagctttcccggtcgtagtacttgtagtcgtcgtaccggaaggcgcggcgctcggtcacccagtcgacgaactcgaggtttccgtacaccacgtcgacgcgggcgcccgggaactcccgcagagtcaggctcttcagcagtccgagggcgagcgagggcatctcgatcgggctccacggcacactgaccaggacgacgtgcatgatgatgcccccttcaaggtgtcacgggcgacgtgcacacgagttgccgggcgagggcgccgagttcgcgttgcaggtcggcggtttcccggcccgagacgtcctcgttggcccgggccagtaggtagcagaacaggtagcgctccaccaggctgaagccgagcgtgtgcagacagctgtagagcaggctggtggccagccggaaggccaggaagtccggatcgcgatgcagcagatgctccagctcggccgacaggtacgtgtggaagcgggtcggcggcagcggcaccgcgcggcccgcgttcaggtcctcgatgctcaggccggcgttgacgacccggccggcgcggaactcgtcgcgcaccggactgaagtgccgtcgcaccatcgcgacccagccgcccgtcaccgggtcgtcgctggacggaccggaaaccgcacaggagcgcacgaggtcgcgggtgtacccgccgaggcgttcgtagtgtgcggcgtaccggcgttcaaacgagtcgggatcggtggcccgggcgtacaccccttcgtagtgcgaccggtagctgagcaggcgcaggctcaacaattcggcgtagccgcgcgacggcaggtcgcgttgctccgactcgagcagtgtggccccggcgttggcgagcatgagccgcaccgcgatccggtagcgatcggccgggtcaccgccgagggccggcagcagctggacgagcaggggggccgccgcccggtagagccgccgggcgacggcgccgaatcccggcccgccgagcccggcgttccacagcggtgacggcacctcctcgaccggcgcctcgaccacgtccggccgcaggtcgtgggcggcggccacccggcgtacccggtcggccgcctcgccggcgccgaggtgggccgaggcgaggctgacctggaagcagtcggcgccggacgtctgttcccaggtgcggacgaaccagtactcgccgggccagggccgggcggacgcgaacaggtcggtaaggaagccatgaacgcgtcccggcgcgccgtcactcatcggaatcgtcacgaacacgtgcacgcggacctcctgacatggtggtagcccgtccgggaaggacggtggccgctgccggggccgtctccgggagacggccccggcagaggtctgccccgtcgccggatcaggacgaggacgaggacgacgagctgcaggcgcagccgctggtcgtgcacgaggccgccatgatctgcgacagcgtctcgtcctcggtgcccgagtcctcgatcagatccgagatctccagggcgttcaggtcgagctcctcatcgatgttctccatgcctatcacctccccccttctccataccagtcaaggtacccgagaaggcgttcaaagaaagcccttgaatagccttttttcagtctggcatcagcattacaagttgcttttgagcagggcaaactccagtatcccgaccggcatccgatcgggcaggaaaagcacgcataatcgagttttttcggccagcgactaccgcgtcggcggcatccgccagagaatttttcaaatgtttaccaaggcatcggaagtgcctttcgcgcccacgttcatacgggctccaattcggtcaacgatcggcacatcacatatgccaggaacgcctcgccggccgggatgatccccaaccggttgttggtggtgtgcagatagtgggcgatgcaccgggcgtacgaagccgtcccgagtgtcagctccgcgaggtcgccgtgcgggccaccgacctcgcgcgccgccgccagcgcctccgcgtacgtgtcgtggaaggtgtcggtggcgtggccgtgccagaccgcctcgcacaggtgacggatccggtcccgggtgcgctcgtacatcccgggccacgagcggtcggcgcccggcggcaggtacgggcgccaccactgctcgtagcgctcgaggaacgcccggctctgctcggcgtcgagcccggacccccgcaacgacatcgccatgatccggatggcatccccggtcggggctcggggcgccgggtcggcccgggcggcgatcaggtcgagcaccgccgccgacgtgcggccgaacagccgttccgcgatccgcacccccgccgggccgccgtacttgccgtactccggccggtactcggcctcctccacggtgccggccgaccgctccggcgccggctgctccccctcccgctcggccaggtgcgcctgcagagacacctcgtacgcgtactcggcggccagctccggggttccggccgggaccgccgacgccagcgcccgcccgatcgactccaccgcggcagcggacgtgccacgcacccgcagccgcaggtgcgggccgccctgccagtagcgcaggaagaagaaccggtcccgcagcccggcgtcgcgcaggagcgggtcgaccacctcgcgcaggaaccgcgtctgcaccgagtgcggcaggtagacgtgcagggcacgccatcggtcagtctcggtagagctcaacgaaaaactcctccgccgccgccggaccgtccccgcgcccgtactcgtcggtcgccggcaggcattctcgaatcgacaggtggacgtcgtcgcgggtcagcgccgacttggccaggctccgcaccgacagcgggttgcggaagtccacgtacatgggtttgtgcacgctcgcccggtgcaggtgctcgaagtcggaccagctgcgcggcagcccacgggtgcggccggacagcaccgcgtactcgtccggggtctggcacagcacgaacgcgtcccgcgggaggccgcggctgcggcgccactcgtcgaaccgcagcagggccgggtacgagtcccggctcacctccgccagcatcgggatgtcccgggccggcaccgtccacgagcggcggtccgcgacgacgtccccgacgaccaggcgtccggcgccgccgggatcccgtacgcggcggatgtcgtccagcgggtgccacgggtaccgggtcgtcgggctcagcgcctccagcagctggtacagcaccggcaccccgaccgggatgaggaagttcatcggcatcaggtcgagtggcgcgccggcggccgggtcccacagcagcagccggtggctcccgtggtcgacccggatcgccaggtcgccgaggccgtaccggcgttgcgccgtcgccgacggccaggaacccggatagtcgaggacccggtcggtcagcggcgggtgcaggttgaagttgaaaccgagcaccgcgttcaggtcgacctgcccgccgaaggcgtcccggaggtgatcgcgcagggccgaccgcagcgtccaccccggcatcgccgacccgtcgatgaaccggcagaaccgggagaagtagacgccgtatccggtgagcacgccgttcaccaccacggccggctgccggtcggcgcgccgggcgaactggacccggaacgtgatcgacgccggatcgacgcggtcctcgacccgcgcgcacgcgtcgtcgacggcctccgggctcaaccgcagcacaccgtcgccgtccggcacgatccggtcgccgagctcgtgcagcgctgcatcgcgccgccgggcgtacgcccgtgcgagggcggatccgtgcccggcgaacaccgcgtcctgctcggcttcgggcagccggaccagttggtcgaagaagtccaggaacggcacggtctcccggtcgccgaaccggtccaccgcgaaggagtacagccccagccgcttcacctggccgtagtcgagcatcgaggcgaagcgccacaggctcgccaaggccggccgggccgcggcgatcgcgtcggcgttccacgtggcggggcgggcgcgggtccacgcgtcctcgtacaccggtgcccgcacgatcgcctccggcggtgccccgacgccgcagaccgcgcccacctcggcgatggcccggttcccgacggccagcagcgcccgacggccggccaccgacgcgtccgggaagtcggtctccagccgccgcagcgtccgcaggtcggcggccagcaccgacagcggtccggcgggcgcggagttcagcagatcggcgagcttcgccgcgtacgccgggtcctgctcgtcgatgccgggccggaacgacagcagacccgtacgcagcagtgcccgcaggaccttccgggccgcctcgtcgccaccggccacctcggccagtgcctgtcgcagctgcggcaccggggccgaaccgccggccagcacgcccaggacccggtccaccaccgggtcgcgccggagccggacgacctgctcggtaccgccgtacccggtggcgcgcccgtccggtcgcaggccgatgaagcgaatcgatttctcatcgatggacagcgaggagttgagcagcatccgacccaggtcgtcaccgcccggcagccgctgccagccgcccaccatccagttgagcagcacccggttgagggtggtcgacgactgtgtgcccggcgcgccgccggcctccgggggcaggtccggcgggaaggcgccgacctcggtgaaccggccgaacggggacggtttcagcgccgcccggtaggcgaagttcaccagcgacgactccgcggtgcgcaaccggctcggcttgagtgcgggaccgtcgtcgcggacgtacctctgcaggctctcatacagctggtcgccggagagctggatgcccttggccatcgcgtcgtgctcgaacagcgcccggatcccggcccgggccgccgccagctcggcgtcgaagagcgtacggagatccctctcctcccggcgcacctcgtcggccagctccagccaggcacgcacctggccggcggcggcgcccaggtgcggttcggtgagggtgagccggcgccgggcggggtcggaccggccgttgtagacatcacggcgcagccggacgatttccgctcgcacggtctggtccgcgcccggcaccagggccgccaaccggtccgcgacctccgccgccacccgcgctccggcggcggcccgccggcgccacccgtcgacccgcgcccagtaccggtcgagccccagggcggccagctcggccaccggcaggcgggcccggcggaacacgacgtacgggctgagtgtcgcggatgcccgggtagaacgctgcaggatctccggtgatcgcacggtcatggctctcctcgctgccgtctcacgggaacgggtggggtgggacgtcggccggggactgcccgggcgccaggccggactggtacggggtcacctggcgcgccaaccgcggcagcccggccatccggcgagtgtggtgcccgaatgtcatcggcaggcaccccggcacgaacacccgcgtacacaccagacctcgccagcgcagctcgggtgtggtcatgtcggccgcgtacgcggacagcccggccgcctggagccgggcccgcacgtggtcgaggtcggcgtcgagccgcgccgccaccggatgtgccgcgaccgcgtcggccagggcgagttcgggtcgctccggggtggtgaggaagtcgaaccagggccgcgactgcggcagcgcgccgagcaggctgtggtcggccatggtgcggaccagcccgaagtcggcggcgagccgccggccgtgggcgcggtcccggtcgaaggtgtgggtgaccgcggacaggatcgcggccacctcgaagatcgccgattcggcggccgcccgcggatgcaggttcgcgccggccgacacgaacgtgcacgggcccgccgccgcgtcgcgccgggcgagtgccagcaccaccgggatgccggtgtccaccgccgcccagtacagccgcagccggaatccggtgacgaccgcgacccggtccaccagctgccgtatcccgcggtcggcgggacccagggtgagttccgggagcagcaggcggtggtaccaggtgagcaggaacgcgtcacgttcggcgatctccagcagcccgtgcagggccgcctcctcgtagctctgccccagggcgaacccgttcgacgtgtcgtagaagaacggccggcgcgacccgggccggtgtgcccaggacagcgccggttcgggcaggtagcgcgggacgccgccgccgagcggcgtgaccgggacccagcgcagccgttcgtgccggccgagcggcgcgaaggggaagtccggctccgcgtaccgggagtcgtcgtggtagccgagcgtcctgggatccaggccctgagcgtccagctcggccagcgacgcctcgaccgcccggccggtgggctggcggtggaagccggtgtagcgttccagcccttccagcaccgccgtccggcggctgcgagcgaaactcaggcagcggccgatgccgggttcccgcccgccgtcgcgcagcggcaagcccacctgcgcggccggcaccggcccgtcgaggtcgacccgtggttcccggaacaccgagtgcgcccccacgtagtcggaggtgaggtccggtggcagcgggcgccggctgcgcagcgtcccgtcggccttgtccagcaggtccggcctggagccgaaggcgacggtggtgtccgccggctcgggcgcgcacgccgggcacgccgagctcggaggcacccgccccggctggaccgtgccggtcgcggcgtcgacggtggcgagagtcccgctggcggtgccgtcgcgcagcagcctggccgccagccggccgacgactacccgcagcgccggaccgagccgctgccacagcagatcagcccgggcggcatccgccggagcgcccgccgggggcggcgcctgcgggccggtgaggaaccaggccaggcaggtgggacagccgccggcaccgggccggtaggcgagcacgtggatccggccgcgccagaacagcacggccaagccccggccgggccggtgcccgccgtccggcccggacagccgggccgggccggtgagcgggccgagcaacacctccgtgggcggcggcgcgtccccggccagcgcggccagcgggtcgtcgagcagcgtcgtcatgccagttccaccacccggagccggccctgggtgaaccgcaccggcgcccggtccggctcggtgacgtccggccgggtgagctgctgccaagcgtcccgccatcgccggaaatgggggttgaccggcaccaggacaccgtcgtcgttgacccggccgaggagcgccgtcgcgacggcctcggcgtagcaggcgcccagcccgtgcagggcggggccggacgccgggcggccggcgacccggtacaggccgttgggcaggcgttcgccggtccacccgatcggaccgagaccggccgagcgttccagatagcggctgacccggacgcacggctgcggaccgaggtcgtcgggcagctccgccgccgcgccggccgggtgccgggccgacgaccggagcagcgcccggtagatcgcctcgtcgagggtccagccggcgccccggttccgcgcgggtgggccggccagcacctcgaccgcgttgagcgccgcctgatagagggcctcccgcgacgacagcgcggcggcgtgcaccgggcgccgcccgccgccgtcgagcaggacggtggcccgggcccgcccgtacggcacctgcggcagctcgccgccgtcgaggtcgaggaatggaccggcaaccgggtcggtccagccggccagcgcggcgacgatccgatcgtgctcgccgtgccggtccgtcccgtcgtgcgggtccaccaggtcccgccggaccaccggatccggcgcttcggcggccgggcgccgccgggcgcggcggcatcggcagccggcctcgatcacggccgggtgtgcccgtacctccggccggtccgggtcgagcgacagcgcggcgttcgccacggtgcccagaccggcggctcggcggcagatcgagtgcgccaccaccccggccgccgtccactcgtccaccgaggtgcccgcggaagcggcgccgaggtgccggcgcaggcagtcccagcacccggccgcgtcgccgtcggaccacaccagccagtaccgggaccccaccgagccggcgatcccgtgcggccggccggcggcccgcagcgcgtcctggatccggacgacctgcccgtgcggcaggccgtcggcgtccacgaccggcagggccgcgccgtccgccgggttctcggacagcgaccggtagtcggcgggcacgccgtcgaggacgtggcgcaggcgggcgagccacgacggccggccgtacaggaccgggacggtgtcacgcatccggcgcagcgcgcgctccgggtgccgggtcagctgggcgaagtagaggatcagccacggcggcgccggctcgtccgcgtaccggctcatcggcgcgtccagcagcaccgcgcagtcccgcgcggtgagcacctcgagcaggcgcgccgccgccggcggcaggtcctggagcagctcggacgcggtccgggtgccgtccgcccggtccagtagcgccgtcaccaggtcggccgcggcggcaccgcgtacggtgaaggacgccgagccgacgcccacccacacaccgccggccctccgccggaccgcgacgtcggggcgggcgagcacgaagccggtggcggtcgccgatgccggggacatcgtcagccctccgggtgggcgtaggtggcggacagcagcggatgccgggtcacgccgtccccgcggaccagccgccggaccgccgcggcgatgaagccgccgaacagggtgccggtcaggccgtacgactggcagccgaggtggaagtcgtagagcgcggccgccgcgcgcaccacggacatccggtagccgtgcgggccggcccacgagtccgcccggtccagcgaggcgtacatggcgacgatccccccggcaccggcgaactcccgctgcacgccgaggtcctcgacgtcgcccagcgcctcgaccggggccaggaacgaacagtcgtgcgccgtcacccggtacaccccggcgggtagtccgcggctgcgcacggcgaagacgaacgcctccaccggcccggccgcgtcgtcgagccgccagtcgagccgatcccggcgcagcgccgcgtgcagcagggcgatcaccaactcggtgcgtacgggctcgtcggcgtaccgcagcgacgagcggcgggccagcagcgtgtcgcgcaggtcggcgtgcggctcggccagcagctcgtcgaggtcgacggcgaccggcgcggcgtccgggaacggcgccggccggcggtcggcggctcgcccgtcgctcgtgctcgtcctggtggcgaagccggccagcagaggccgcatggtggacaggtcggatcgcaccgggtcaccccaattccaggacggcggcgacgggttcgtcggacgggagaagccccaggcactcggcgaggacgtcgtcgtcgaagtcgcgggcgaggtcgtacgccagaccgaggtgaccggcgaccgcccgggccgcggccaccgcgcatccggcgtcgagcagcgccagccggagcccgaaagtgccgtacttgcggaccaccttgcgcaggttggcggtgatcaccagcaggagcggccggttgccgggcggcggggtaccggacgccatgccggccagcgcgtgctcctgctcgacgtacgcgtaggcgccggccggcagcacggtgtcgtcccggcacagcaggtacgcggtggccgagccgatgttcccggccgcggcggtccagcgccgtaccgcaccgtcgaccggcgactgttcccgtaccccgaacgcgaccgcgagcagcagcgcgacctcgcgcggtccgggacgccgcccggtgccgccggccggctccccggccagccgcgtcaggtccgcggccggcagcggccggcgggggcaggtcggccacgtccggaactgcgacgacagggcgatgttcgccgactggtagtgggccaggtgccccttcgggtcgaggaaccggcgtgggggtatcgccaccgcggcctcgtaccgggccgcggcgggcggctcggccgcccgcaccccggcggcgaacgagcaggtggggcagcccgggcgggtcacggcggcgcggtagcgcgtcgccagggtgctcaggtccacctcggccgcgtcgagcgggaggtgggtcatcgtggcccggccgaccagcgccgtcacgtgatgggtcaccaggccggcgaccaggtcgccggtcccggccggcggatcgccgtcgggtgcaccctccgccgcggtcccgcactcgagacacggcgtgaaggcgggatcgacgtacgggccgaccgtcaccgcggtggcgccgacccggacccgtagcagcggccgcccctcggtccagcagcggcgccgcagggcggccaggtcgggcgccgagccgcgggtctcgaagaacacgctcaggccgtcctcgccggcggccgccggccgcaactctccggtcaccggccggccggcaccgtcgagacatcgggccgccgtcgccaccagtgacgggtcgccggccaggtgcacgaccgtccgcgcgagccgccgcgcggcgccggtccaggaccggttcgctccggtggagttacccagccgggacagcaggcaggcgaactccggcgccgccgctggcagggcgcccggcggatcgccctcctcgaccgcgccggcggcccacagcagcgcgagtgacttgtagacggttccctcgtccagtccggtccgggcggccaggtcgcggtggcccagcgtcccgtcacaggccgcgaccagctgggtcagatggtcgcgggcgaaccggccggtgaaagcctggggccgatccgcgccgtcgagcacgaccgtgtcgccggaccggcgcaaccggacaccgcggcgcaccgccgggcgcaccggcaccgcaatctgcatgtcgcggcgggctgcccggccgatcgtctcggcgttcacctcgaccaccatccgtacgctccttcactcaccggctgctcgggactcagggaagcccggcgaccgctccggcgccggcgggcgcgccgtcccggaatcgggccccgcaccgccggcagcggtccaccgccaccgtggaagcggacgacagcgtgccggcgaccaggtcgaacgtgcggaccgtgccgccgagaccgaccgggccgccacgcatctcggccagcgccagccccagcaagccgtgcgtgaccgccaggtgcggccggccgaatccctcgggcaggtcccgggtcgcggcgctcaggtcgtacggccggcccgggtcccggtgctgctcgatgcgccgccggtagcacgcgtgacacgcggtggcgcccgggatcaccgccgggccacagacgatccgggtcggcagcaactccacgccgacggtcgggacaccccggtcgaacccggcccggtcgagcgcgtcccgaaggtcgtcgtcgcgcccggcgtgcagggccacgatgatccgggccgtgctcagccgcgcgtcgtcgggaagcacgctgccggtcaccggaatcgccgcccggatgccgtacgcctcggcgtacccggtgccgaacgcgtcccgtaccaggtacacgtcgtcctcgggtcggtcggatgtcacctgctcgcctcctacgcgaacggttgcgggtcggggttcaccgactgctcgtcgcggcggccgtggcccatcgcctccggtgccgcatacagccggggcgtgcccaggtagcgctcgctgtggatgaacgacaacggcaccgcctcgggcaccaggaccttcaccgcgtacatgccggcttgccgggcctcgtcggtggtgaggtccaccgcgagcacctcggcaccccgggcggccacccgatccaccgcggtcgtcagcgggtcggcaccggccggcaggccgggcagatcgggtagccgccgcaccgtccgttcgccggcgagcaggtgccggaacgcgtcccgccgggcggccgcggcgttgtaggcggccgagccgagcacgttgaccgtgccgtcgtccggccgccgtatcggccggcgggtcacgtggtcgcgcaaggcgagccgcagggcggccagctcccggtacaccttgccgaccgcctgcccgggatccaggtcgcaggtggcgcacacgatctgcgcgagcgcgtcctcgtgctcggcgagttgtacggcgtacaccaccgggatgccgaagtccgtcgtcgcgtcgaacaggcgtacctcgaggtggccggcggtaccggccgcgcgggcggcgcgggccgccgggtcgagcaggccggggtcgaccgccagctccggcagtggcaggcggtgcagccaggcgagcgtgagggcgtcccgctcgaccacctcgagcagtccgccgaggacggcccggcggatgtcggagtggaccgccgccccggtggtcacgccccgggtgaacagttccgcggcggtccgcggggccaggtgcaggtacaccgcggcggccggcaccagcacggcccgtcgccgggtcaacgaccaggcacgcacccaccggatcgggacgcccggatcgtagggtcgcagtccgcagtcctcgcgccggaactcggcggccgagcatcgcggccagcgggcgggcgagacgcactcctcggtcagcgcgtcctcagcggcgaagatcatctcgtcgtcgtgccaggagcagatcgagtagcgctccagcgcctcggcgaccgacgtcagccgggcccgttcgccggtgagcgcgctgccgaccccgttgatgttgcccatgtcgccggcgtcgctccagccgcgcatgccgtcgagcactcgcgccgggtcaccgatgcccgccacatgcaccgcgaacggcggatcggcgtcggccggcggtagggacacggtgcgcgacaccaggccgaacggcgatatcaggaatgcgagccgacgcagttcaggaccgcacggctccgcgacaatgccccgtgacattgataagcaccaacccccgcgtcagctgtccacgacaccattacccaagcgccggaaactgtcaaggcggaatattgttgatcacgggaagggacgcggtacgttgctccacttgagatcaaaaagccttttaggcagacctgacctgcacttaaacgtgtcatcatcaagatccgccagcagtgcgacccggtccgatgacgccttttcccggagatcatcgagtcaatttccggcgatcgccgccgggccgcgcacggcaatcccggaaaacctttccctcggcattgcagccattctccacattgtcgtcgcggttgatgaccaggaattcacacagtgatcccaaccccgcggcgacctctgcgaatccaccttccggcccggcccgagccgtcgatccggcccgaggcgccggcgcctcgggacccacttcccggcacacggcggcgatccggcgcggcggccaccttgtcgcccttctcgaccagatgactcaaaaaggcgagccatttccgtacgccgcggatcgtcggagttccggccgcgccggtcgtcacccggctccgctgagcctcgaagccggcgtagcccgtccgacggccgcccgagccgcccggacaggttgggcgcctgatcttgctgggcggcagtcacgtgcacagcgagtcgcggcgagtccgtcaccggcggctccggcaggtccaccgcgagagccccggttgcggcggcgcacgtcccagcgagggcaggccgcgactcaggcccatcgaagcccgtgggcacaggccagagcccggctcgtccccggtgcgcggcgatcaaaacgagccggttgtcgggatcagaggctcggcaggtgcagcagggcgatgtcgttctcggtgaggctgcccagggccagggtgccgtggtgttcggcgaccgaggtgacgaagccgtacgacccgtcgtcggtgcgcaggtcgtgaacgaggtcgccggccagggtgaaggccatcacccaggcgatcggggtggctttcgggcggaccgcttcgggcaggttccagaccagcaggcgcaggaagccgggcagcggcagcagccggtcgacgagtgggttgcgcggcgccgcgatcgccacccagagcaggccgtcgctgcccagcgacatgttgtccgggaagccgggcaggttctccaccaggatctcggtgcgcccggcgtgcgggccggtcaggtggtgccgccggatccggtatccggcggtctcggcgatcagcaggtgcgactcgtcgggggcgaggaccaggccgttgccgaatttgaggtccgggatcagggtggtcagcgtgccgtccgggtcgcggcgcaccagccggccggtgctggtgtgttccatgatgtcgccgaggtggtcgtcgagcggccagcggctggtggacgtggtgaaccagacggtgccgtcagcggcctgcacgacgttgctggcgaaggtgagcgggacgccgtccacggtgtcgcagagcacggtggtcgttccgtccgggcgtaccgccaagaggcctttgtcgtgatcgcacaccagcacgccgccgtccggcatcggatgcaggccgagcgggcggccgccggtgttcgccaggacggtgtgctcgccggtgtccgggtcgatgcgcaggatgcggccgtcggcggtgccggtgagcagctgcccggtgtggtcgaactggacgtcctcggggccgtggccgtcggtgggcagcagccggtcgacgcgcagcggggcggtcgggccggggtcgttcagggtgggcggggtccagcggcgaggattgatcagacggcgcgtcatgcgggtgagtgtgcccgccatcagcgcgaatcgatagtgcctacgggcagcccggcgaggcggcggcggcgatccgcagatcgcttccggtgacggtgagctgcaggccacgcgatgtcacgccggctttcgtgtactgcaggccggcgggcagcggcggcaggtcgacggtccgggcctgggcccggtcgcccaggcgtgccgcgggtatccgcagaccgagagccgggatttccacctcctcggggcgcagggtgagggtgccgtcggcgagccgcggcgcggcgtgcacgatcaccgatcgcggctcaccgagcagctcgacccgcatcggcacggtgagccgtccgctgctgtccgaaccgtacgccagggcgacctcggccgtgagcgacccggcccgcatcgtgccggtgtcggacaggcgcacgtcgtgggcggtggcatcgaccgcggcggtgacctgtcccaccgtcacgtgcggcacctggacgtgcaccgtaccgatattcctgctcatcaactgcggcaggaacggcatcgcggtgaacgacacgtccgggtccacgtccagatgcccggcgcatcgcaggcggtcggcgaggcggccggcggcgcgggctgcgacgatgcggtccgcggtgacggcgagaccgagagttagggtaagcgcgacaccggcgatcatccatctgctacgcatcggccccgtccttccaccggcggaccaggccggtgacgagcacgcaggccaccagcaggccgacggcgaccgtgatccgggtgccgtcgccggtcgaggcgccggccgggtcggacgcggccgtgccgtccatccggaactgccacatcgccgatccggtggccccctcgggcgcgccgtacggcagcgcctgcgcggctcgccggtccatcgcggtgaacagggcggagacctcggccggtgtcgccgagccggccacgatgctgtcggtcagcttctgtgtgccgtcgctgtgcaatcgtccggcgccgcgggtggcggcggccccgccgtcggcacccttgccggcttcggtggcgagccggcccgcgccggtcgccgcggccctggtgccgtcggccactgccgcctagctagctaggcggcgagctgcgcggcgccctggttcacctggccggccacgccggtggtgcgaccggtggccgacgccagggcggtgatgccgtgaacctgctgggcgagtccggcgaccagcgcgtccaggccctgcgccacccccttggcggtgtcgccgccggccgggccggacaacgccagggtgaggcgctgcagccccgccgcggtggtggagatgccgtcgctgagcacggcggcggcgtcctcggcctggccgagcccggagccgagggcgcgcaggccggtggcggccttgctgagctcgccgctgagggcgtgcatgccggccgcgctgccggtgcactggtgcgcggcccggcgcagatccgcacagtcggcggccggcagtgggccgttcggcccgcagtcggcgtcgacgatgccggagaccagcgtcgcggtgccggaggcggccgtggacagactgctcgcggtgccggcgccggtggcgatgcccgcggcgatggtcgtggcgtcgcccgcggcggagctcagcgtgccgtggagccgggccgcaccggcgccgagcgtgtgcagggcgcccagcacggtgtccgggtcgtccgcggagccgagctgggcggcgatctgctcgacggcggtctgcagcgcctgggcggcctgcaggctggccgacatgcccgcggcgccggagagccggctcagcgcggtgtccagttcggtgagtccggcgctgagctggcgggtgccggcggagagcgcgtcggccgaggaggcgaccttgccggtgccctcggctagccggcgcgcgccggtgctggtccgggcggcgccggcggcggtggcgtcggcgcccgggaccagctgcccggtgagttgccgctgcagggcgtccgcgccggtggcgagctgggtgagtccgtcggcgagtccggcgacgccggcgcgcagcgacaccacctggtcgtcgacgctgccggcggcgtcggccagatgggtgttcgccccggtggtgctggtgaacgtctgcccggcgaagcggctcgccgggtcggtgccggtggtggccgggatcagttgcatcgtgacgtcgggtatctcggcgtcggtgacggccgcggagagggtgaccgtcgcctgcgggttgcccatcggtggtgccagcacgaggttgtacgcgacgtgactgccgccggtggcggtgccggcgaccgtgccgccctcggcggacacgtcgcggtaccggctgggcaggtcggcgaccaggtcaccgacgagcgggaggaacaccttctcggtgacggtgtgcgaggttttgccggcgtcccggtaggtgatcgcggtgggctccgcggtccggttcgtcaccgtgtacgtgatcttgaggtggccgctgcgtccccgcagggcggccggcgagatcgtcgcgccgtcgagttcgtagtgggcgtgcagcgtgatcggtacggcgccggtcacggtggatgcggtggcgagccggtcgcccgccgtcaccctctgcaccagccggtcgccggaggtgtccggccggccgtagcccaccaggttgcgcaggccggcggtggccgagggattgcgcagtacggccgtgccggatccgtgggcggcgaggacgtcgaccagcgtggcgccgaccggcacgccgctggcgtccagccgcacggtcacggtctcctggtcggtcacctggagcgcgtccggctcggcggcgcgtgccgggacgaccggcagcggcaggccggtcaggaccagcgtggtggtgacggcgcccgcacggcggggagtccagctagtcatcgatcagctccgatcgtcgagggatccggcgagagctgccggcgccggaggccggtgccgagcaggcgtcccagcagggacacggtgaatccggcggccgtgcacagcaggacggtggcttccggttcgccggcggcccagccgacggtgccggcgaccgtcgccgccagggtggcggccggtgggatgcggccccggctgagcagcggcggaaccgcagcgagaagcacggtgagcgcgatggtcagtccggccgccgacgggagctgcggcagtccgacggcggccccggcgaaggccagggtgctggtggccgcaccgatcagcaggccggcgccgcgggcgccgacgccggcccgctgccgccggccggcgacgaacgcgccgagcagcagagcgacgacggccggcgtcgcggcggccacgctgccgcggtgcacggtcaccacgatgatcaggacgatgagcggcacggccaccgcggccgtgctccaccggccgccaccgatcgcgacgtcgtggccgttccgggccggtgcgaccggcgggctgtcgaagaacgcgggatcggcttcgatggcgatcccgggcaggagccggtcgaggagcgggggcagccgccactgccgctcgccgatcaggaccatgaccccgggcacgagcaggcagcgcacgaccgtcgcgtcgacggccaccgccacggacagcccgagaccgaacatcttgacgaccggattcgcgttgatcaggaagctggcgaagacggccaccatgatcagcgccgcactgctgacgatccggccggtgtcggccagtcccaggctcaccgcgcgggcgttgtcccgggtggcgtgccagtgttcctgtatcgagctgagcaggaagacctcgtagtccatggacaggccgaacaggatggcgaacatcatcatcggcacgtacgactcgatcggcaccggcccgtccagacccagcaggccgacgccccatccccactggaagacggcgaccacgacgccgtaggcggcggcgatcgacagcaggttcatcgcggcggccttggcggcgagccagagcgagcggaaggcgagcagcaccagcaggccggcgaacgccagcaccgccccgatcagtaccggcagccgctgcgagatccgcccggccaggtcggccttggtggcggtgagcccgccgacgtgtccctcggcgccccggcccgccagcgcccgcggcagcgtcgtgtcgcgcagccggtgcacgagctccacggtgcgctcgtccgacggcgaggtctgctcggtgacgccgaagaccgccacggcggagtcggcgctgatcaccgggtcgctcaccgtgcggacgccggggctctgggccagcgcggcgcgcagcgccaccagacggtcgtcccgggcccggggatcttggccgtccgtcgtcgaggcgccgtccggggcggtggccggagcgaacatctcgacgacgacccgcaacgggccgttggcgccgggcccgaaaccctcggcgagcgtgtcgtaggaacggcgtgactcggtggcggcgggcagccggccggcgtccatctgaccgagccgcagggcgaggacgggcgcggccagggtgagcagtaccgcggtggcggccagcgtggtggtcagcggccgcccggccacgcgtacggccaggcgggcccaggcggtgccggcgaggtcctcgggaccggtgacggccgcgccgcgccggcggccgggcagcgacagccggttcacgccggggccgagccagccgagcagggccggggtcagggtgaccgcggagcccaggctgaccgcgacgacgatggccgccgagtagcccagccagccgacgaaggcgacgccggagagcgccagcccgcagaccgcgatgaccacggtgccggccgcgaagacgatggcgccgccggaggtgcccgccgtgcggccggcggcctcctcggcggtgaggccgccggcgagcagccgccggaagcggaccaccaggaacaacccgtagtcgatgccgacccccaggccgatcatggtggccagggtggcggcgaccgtcgggatgccggccgcgttgcccagcagctggagcagggcgaggccgccgccgacggacagcaccgcggtgacgatcgggacgcccatggcgacggccgagccgaaagccaacagcatgacgacgacggccacgacgatgccgatcagctcgctggtgtgcaccgggctcttcgacagctgctgaccgagctgcccgccgacggcgacgtccagaccggcgccggtggccgggccggtggcgtccctgacccgctcggccaggtcgagggtcgaggcggagtccgactccggggtcacggtcaggtagccgatgtggccgtccgggctcagcgccgcgtcgccggccgccggtgggtcgctcacctgcccgacgcccgggatccggcggatccgctgcacagtgtcgcgcagggcgtccgcgtacgccgggtcggtgacgccgccgcttcgcgccttgagcacgatcgggctggcgtcggccgacctgccgggaaactcgcggtccagcagggtctgcgccaccgcgctgtcgctgccgccgacggcgacggcgtcggtgctgccaccacccaggcggtgaccgacgacgatgaccgccaccgccacgacgacccacgcgacggtcacccatcggccgtgccgggcacagaaccggccgagccggtagagaaggttcgacacgcgatcaacagaaacagccgatccttaccgggtaccgtcgctgaccctgacggttcgctgaggactcgccggcagcgtgatccgggcctccaggccgcccccgtcgtcgccgcggtcgtgcagggtcagcgtccccgcatgctgctcgacgatctcccgggcgatgctgagacccagaccgctgcccccgcccgccgcccgtccgccgtcggctcgccagaaacgctcgaacgcgcgggccagcagctgcggatccaggccgggcccgtgatcccggacggagatcaccagatcgtcgtccacgccgtcgacgaccacctcgatcgggctgtccgcgggggtgtggcggaccgcgttgccgagcaggttccggaacacctgcaccagcgaagcctcatcgcccagcgcgatcgccggccccggcgggacccggagtgacacgctgcgttcgggctcgaccacgctcaggtcggcgaccaggccgccgaggacggcgccgacatcgaccggggcccggtccagcgggcgccgggcgtccaggcgggccagcaggatcaggtcctcgaccagccgctgcatccgtccggtctccgcaccgatgcgcgcgaacgccagatcggcctgctcccactgcgagaccccgccgttgagatagaggtcgctccacccgcggacggtggtcagcggcgttctcagctcatgcgacgcgtcggccacgaagcggcggatccgggcctcggcctcctcccgttcgctgaaggcggcgttgagctcggccgccacccgaccgatctcgctgtgcggatgcggcaccgggatccggcgctcgcgctggcctccggcgatcgcccgggcggtgtccgccacggtgcgcagcggccgcagaccgaagcccagcaccagcgtggcgaccgccaccccggcgaccaggatggccgtcgacgcgatcacctccaccagcagcagccggtgcagcgtggcgtcgacgtcggccagcgacacccccacgatcagggcggccgggtggacccgcaccccgccgatggtcagcgtgatccgcggcggcgcgcccggcagggtgatggcggccagccggtagccgggaccggcaccggcgctgggtgcggtgaacggctcggacgtggccgggatcggcgtcggcagcaccggtggcgtcaggtcctcgctgcccgacaccgcggcgtgcgccaccagcagccggccgtccggatccagcacggcgacgtactgggtaccgggggcgagcacccgcaccgtctcccagctgatcgccgccccggtcccccggccggcctgctcgtcgatgcggctcgccaacgatctcagggtcacgtcgacccggtcgccgagaaaggtccggagggcggcgtacgcggacgcgtcggcgaccagcaggccggcggcgagcagtgccagcgtcccggccagcagccggccccgcagcccctgccaggcgccggagccccgccgggccgcgagccccctcatgcgaccggctcccggatcgcatagccgaagccgcgcacggtgtgcagcagcgggaccgcgccgtccgcgtcgatcttgccgcgcagctggctgatgaacttctccaccaccgccgcgtcaccgccccactcgtagccccacacctcgcgcaggatctgccggcgggagagcaccagctcgacatggcgcatgagataccgcagcagccggaactcggtcggcgacagggtgatcacccggccggcccggaccacccggtgggtctgctcgtcgagttccaggtcacccacccgccgtgcggtcgtcggcgccgcgccggcggtgcgccggagcagcacgttcagccgcgccaccacctcggcggtgctgaacggcttgatcacgtagtcgtcggcgcccagggtcaggccggccacccggtcctcgatgctgtcgcgggcgctgagcagcaacaccgccagctgctcgtcgcgcgcccgcagctccaggcacagatccaggccggagccgtcgggcagcatgatgtccaggacggccagttccggccggaactccgccgccagcgcccgcgcctgcgcacaactcgccgcggcccggacctcgaagccggcgaacgagagcatcgcggtcagcacctcggcgatgggcgcttcgtcgtcgaccaccaggacgcgggccggccgcagggcgacgagcccggccgtgcgtggtcgcaggccgcccgcctgccggggatccgccgggttcggagtagtcacggttccacgatgccgtaccggcgcggccgatgatcttcccgccgcctgccgggaacctgccgattggctgaaggctcccgcccggggacatcgcgggttgccggcagtcgtcaccctgagcgcggggaggtggccatgcagatcatcgaattcaccgatctgggcgttcgctcggccgtcatccggttgcgccgccgcggcacaccgatgcagttcgtgatctatccgatgattcacatggcgcagccggggttctacgccgcggtcacccggcggttgacgaaggctgacgtgatcgtggcggagggcgtccggggcgggagccgtccgtcgctgctctccggtgcgctcaccatgagctactccattctgcggttcaaccggcgggccggactggtcgaggaggacatcgactaccgggccctgggccggccggtgatcgaaccggacgtcaccgcggacgagttcgcccacggctggcggcggataccggtcctgcaccggatgctgttctggctggtgctgccggccgtgctcatggtccggatggtcggtggcacccggatgatctggacccgggaggtggagatggacgacctgcccagtgcgcaggacgaggcggtgaccgatcgctacccgggcttcgacgaggcgatgctcggcgaccgggatcagcgcctgctggacgcgctgtcccggctgcacgacgaacggcacgaccaggagatcgagatcgcggtggtggacggagccggccacgtgccggccgtggtccacggcctggccgcccgccacggctaccgcccggcctcggccggctggctgaccgtcgccgacctctgaccgggcctggccccggcggacaacggcgggcaggccgtcagtcgcagatcaggtcgtcgagcagggtcatcccgcgctgcatgacgggagccgcctcggtcaggtcggtggtcaggtagaagaccgccgatcggtggccgccgggcgccgccgcctccatgatctccatcccgggcatgccaccccagtgtgcccagtagccgccgcaccggttcggcacccacatgatgcccagtccgtaggtgatgccgggccgcagtgcctcgaagtcgccggccggcaccgtccggcgcatctcggccatctgcgccggcggaagcagccggccggacgtcaccgcctgccagaagcgcgccatgtcggtggtggtgctgaccagcccaccggccgaacccgccaccgtcgggttgacgatcgtcacgtcgatcagcggaccacccggggtgaaatgctggtacccctcggcgtgcggccggggcagggtcgaccggtcgccggggtagaacgtacgggtcaggtgcagcggcgccaggatccgggaacgcacctcggtgaaccagcagcgtccggtgacccgttcgacgagcatcccggccaccagatagttggtgttcgagtagctccaccgggtgccggccgggaacagtggcgggtgctgcatcgccgccgccaccagttgtgcctcggtgtggtggtcgagccggtgcgcccggtactcgtcggccgacttcagcacggcgaggtcaccggtgccgtcgtagagcccactcgtctgttgcaggatctggcgcacggtgatgtgccggccgtcgttgccgtggccgtcgacgacaccgggcagccagttctcgatcgggtcgtccagcgtgatgcggccctccccgacgagttggagcagcaccaccgacacgaacgtcttggtgtcactgccgatccggaagtacccgtcggccggcatcggcgcgccggtgtcccggtcggccacgccgctgcgggcggcggtcacccggctgccgtcgcggatcaggccctgcgccccggcgacgccgagacggtgcagatcgtcgagaccacgctgcaggggcgtgggcggcgccgccgacgcgccgtgcccaccgaccgtggtcagcagcacgccgaccgacgccgccgccagggcgcgccaccaccgaacgttcatgagaggttcccttcacgaggacagcttcgcctcgaaggtaggaaagacgccggtgcgaaaacagccggccagcccccacgccggcctgggggtcaacccccaggccgcgacagactccgggccagccccggaatcatcaccgccgcggcgatcaggtgaagggcgagcagggcgagcacggtggcggggttacccccggagagcaccggggcgatcagcgagagcacggtgaggaccgcggtgatcgtgacgaacctgacggcgggtacggcgctccaccggcgcagcgccaccgcgatgagcactccggcggtcgagaagatgccggtcatcaccgcgaagccgggcagtgggatggattggccgccgtccggcagttcgaagtcgacgccggcgcaccgggcgagggccgcggtgacggtggtcgcggccatcgccgcgagggtggcgagcaggccggtacgcagcacgctcatgccgcacccaggccctccggcaggcccagcgacgggaaccggtcgcggtggaaggtgatgatctcggcgatcgccccgccggtgatccgcaggacgtccagggtcagcggcagacacgcctgccgcgcggcccgccagtggtagaaggcgacggcgggctgccggttcaccgcggtcggcacggcgcgcaggccggtcatcccggcgaagccgctggcggtccagtcctcgaccacggccccacggccgaccacgaggcccggggtgggcggcatcgagtagcggatgtcgtcacgcagcagggtggccagccgggcgatgtcgggggtgacgctggcctcggtgaagcggcgcaccaggtcgcgcgtgccggggtcgccggcgccgccggtccagtcccggcgttcggcgggcaggtgttcgcgcatgccggcccgggcccgctgcagggcgctgttcaccgagttcaccgagtcgccgagcaggtcggcgacctgccgggccggccagccgagcacgtcgcgcaggatcagcacggcccgcgggcggggcgccaggtgctggaccgcgacgatgtaggccagttcgatggtctcccggtcgacggcggcggtctccgggtcgtcgagcagccggtccggatacggctgcagccagagcacctcgccgccggtggccggttcggggcgggtcctggccagcaggtcgaggcaggtgttcgtggcgatccggtacagccagcccggaaggtcgaccggccctcgaaggtctcccgccgccgccatgcccgcaggaatgtctcctggacggcgtcctcggcgtcctcgaacgagccgagcatccggtagcagtgcacgtgcagttcccgccggtgccgttcggccagcccggcgaacgtctccgttgtctccgcgaccattgcctcgtccttccgcgtcgtcgacctcgtacgcagatatgacgggcgggccggcgaatagtcatcacagcagtcgccgcggggacgtgccacccgggccggagaccggtctccggcccggggtgccgcgctcagcaggtgccgttgtcggcccagacgtcccactgaccgctgtgcgtggcgggcgactcgttctgcgtccaccacttggcggtgtacttgtggccgttctggctcacctggttgccctgggtgtaggtggccgtcgcgctccacgcggcgaccgtgcaggtgccgccggtcggcggagtgccggtggtggtcgacggcgaggtggtcaccggcggggtggcgccggcgaagcgcgccgagtacttggtgaactcccacggggtctgcgggacgctgctgcacgtgccggaggtggtgctctggttggggtcggcgcactgccggtcacggttgaccgaccagttggtgtagcgggccagcttgtggttcagcgcgtagtccagggtggtctggaagtcggcctgccggaagtactcaccggcgtcgctgcgcccgttcatctgggagatgccctcgtgggcgtacgcggtggcgctgtcccagccgaacgtgttcatcaggagggtgtggaaggcttccagcgcggacacctgggcgctgccgccgctgaaaccgccgtcgaacggcatgatcgagtagttggccggggtgaagccctgcgccttcgcctcgttgagcatctgggtgccgaaccagccggtgccggccgccgtcccggcggtcgtgatcgacacgtacaggccggggttgttgttctgcaggatccgggcggcgccgatctcgttgtgcaccgcggcggtgttctcgtactccggctcttcaaggtcgaagtccatcgccttgagcccgtacttggtgatcacctgctgatacgccgcggcggtggcctccggggtgccgcaggtctggccgagcttggtgccgccgtagccgccgatcgagacgctgacgtcgccgccgttgccgcggatcctgctgatcagcgcggtggcggtggtgtcgtcggcgaccgggcgggtgccgtcccaggtgggcgtgcagccgccgccgttgggggccaggatgaaggccagttggaaggccttctgcccggtggcgttcatgacctcgaccgggtcgggcgggctgttgtcgaacggcatcagatacggcgcggaggcgtaccagttgctggacagcgtcgcggcgtcggcctgagtggcgacggcgatgccggcgccggccagggccacggcgccggccgcggcaatgagaatcttcttcatgacatctccggggacgaggtgacgcatgtgaatctttaacaaagtttcctaattgattacggcgcgtcacacccatgacagatgtcatgcgtttcacaacattgacaatttccgatgtacgtcgttacggtcctccactgttaggaaacctttctaagagttcccggaggtccacccgatgaaccgcaaacggctctgtgccgcggcgctggcgaccgccgccggtgtggccgcggcgatgacggtcgtgcacgcggccgacgccgccgccaccccgctgccggcccacgtcttcgccccctacttcgaggcgtggaccggcgacaacccggccaccctggtgcagcagtccggcgccaagcacctgaccatggcgttcctgcaggccgccaccaagggctcgtgcaccgcgtactggaacggcgacaccggcagcccggtcgcggcgtccaccttcggggccgacatcgccgccatccgggccggcggcggcgacgtgatcccgtcgttcggcggctacaccgcggacaacaccggcaccgagatcgccgacagctgcaccaccgtcagctcgatcgccgcggtcttcgagaacgtcatcaccacgtacgacgtgacccgtctcgacctggacatcgaggacaactcactgaccaacaccgccggcatcgaccgtcgcaacaaggcgatcaagctggtcgaggactgggccgcggcgcagggccggaccgtgcagttctcctacacgctgccgaccaccacctccgggctcgccgactccgggctggccgtgctgcgcaacgcgatggccaacaacgcgcgcatcgacctggtcaacctgatgaccttcgactactacgacggggccacccaccagatggccgccgacaccaagaccgccgccaccggactgcacgaccagctgcaccagctctacccggccaagaccgacgcgcagttgtggaacgcggtcggcgtcaccgagatgatcggcatcgacgactacggcgcggccgagaccttcaccaccgcggacgccccggtggtcgcgcagtgggccacccagaagggcctcggcctgctgtccttctgggcactgcagcgcgacaacggtggctgcccgggcaccgcgggcagcgacagctgctccgggatcagccagaccacctggcagttcagccacgccttcgcggcgttcacctccggcggcggtacgacgtcgagccccggcccgtcggcgtcggtctccacctcgccgtccagctcccggtcgacgcccccggccggatgcaccgcgccggcctggaacgcctccagcgtctacaccggcgggtcggtcgtgtcgttcaacggccacaagtaccgggccaagtggtggacgcagggcgagtccccggccacccacagcggccagtgggacgtctgggcggaccagggcacctgctgacgcgtacggtcaagaaagtcttgtgtgggaaggctagattttctttcgaggatcggctagccttctgagtgttgaaagcagagatccgttgaagacgcggacctggtcatcgagcgtcaagcagggcccggatgtcgcgtggctcgcccgatgaccaccggccgtccgcgagtcgtcaaaggaacatgttggataccccgtaaaccctgggccccggcgcatcagcgccggggcccttgatcacgctgtccggaaaggtgtccatggcacgatccgaagagttgttcggagatgacgactaccccgcctacacgatgggccgcgccgccgagatcgtcggtgccacgcaggacttcctgcgccgcctcgacgaggagaagctgttcaccccgatccgctcccccggcgggcaccggcgctactcccggtaccagttgcgcctggcggtgcgggcccgcgagatggtcgacgccggcaccgccctggaggccgcctgccggatcatcatcctggaggaccagctggccgaggccctcgagatcaatcggcggctgcagcccgactcgccggccgaggcaccctgaccgtcccggcccttctttgacgttttattaacgcgccgtgatggtcgcacagcggccgatgagtgacacgatctcctcgacggccggaacccatcgccggggagacactgatggccgtggccgagcagcccggcgtgctgcgcaaccggctgctggagaagctcgccggccgggcgcggcagcacgacgggccgcacgccgccgagcaggagcggactcactcgtggtggcgggtccggcactcgcacgaggtcatcgtcacgctgttgttggtcgcgctggcgggtgcggcgatcgcggtcgtcctggtctgggtgtacctgggcctgaacgtcgtggtgatcggcggcgccccccggcgggtggccacccatccacaggtggtcaccggctgggccacggcggtgacagtcgcgcatggcagcccgccggcgatgaccgggatcgctctgctgatcttcccgaaacctgcgctcgggcggtccgggttcgagaccggggtggcggtcatgccgcacatcgagggacctcgaccgccggatccgcagcggccggcggctgctgaccaccgccgcaatcgagagcgtggtcgcgaacttcgcccgctacctgacctggcccggggcttgaatgccgggccggtgcaccatctactcgggtgcgaacggatggcggagccgaagcatcgcctgctctccgcggtctgatgcgctgagcacgggtgccacgtcgttgaccgccggggtcagaaatggagtcagggttcccacagcggcagcgggggccgctgcccggaaacgcgaaagttcggatatcggcgcgtgcggcgccgcggtgatcgtcgtcataaaagcttccttgaacggcacgtcgcgtcgaagcacgcgccgacagatatttgggggaaaattcccgagaattgtcgccgggaaatgccggcggtggctcgctgaaccagtcgagacgccgccggcattggtccagatcagataacgcggatgttcccggcctgcgggcccttctggccctgcgtgatgtcgaactccacccgctggttctcgtccaggctgcggaagccattcgccgagatggccgagaagtgggcaaacacgtcgggcccgccctcgtcctggctgatgaagccgaagcccttgtcgccgttgaaccacttcacggtacctgtagccatgtctttttccttagcaagctgtcggaatccgcactgcgcggactctcacgccgccgcgttgatcatccgcgtcgcatcgacgcgggaaacgaaaaagcgcctggtggggttcggatgaaccatcaggcgctgagaacgtctatggaaatcaaaactgcaacatggccaccatagcacacaaattcggatgccgacccgagatttccccgccggtttcagcccggcgctcctgggcgtcaattcctccggccgatgcaggtcgctccgcaaggatgagacggtggatgtcgaaccgattttgatctttgtcctcgcagccgtcccggtggtcgcggtggtgcggtgggttgcaggacgcaccgggctgcccgccgccgcgtggagtcgggctgccggccagcgcgatccgcggctcggcggtgacgacgccgcccggctccccggcgtcgtgacaggcggcgctcacgccgcgcactccgcgaccagcagcagcgcggcctgctcgcggcgcaggcacacgtcgtagtcacgcacccggtagatcaccggatcccgcagcggcgcccggcgcaccacctccaccgtggtgcccggggtgaatccgaggtcggcgagccggcgcgcggtggcggccggtgcgccgggggcgacacccaccagggtcatccggcggcccgacggcacgtcggcgagcacgccgggacgggtcgaggcggtggcacgatgcgaggcacccttccaacataggtagcctccccttagtagcacgggtcccgagcgttggatttccggccttccccatgatccggaggaccagcggcccggaaccgcgcggacgcgaatgatttcagcggtccaacgcccgagcgaccgccgacgcgatctgatcatcgtccgcaccgagcagacgggcctcacgcacgaacgtggcagcacgctcgcgtaaggtctcggccggattcgccccgggcggcggtagtgctgccacgcgggtcccgccgcctcggcgggagaccaccattccggccgcctcgagttcgcggtatgtccgggcgaccgtgccgacggccagccccagatcggcggcgagctggcgcaggggcggcaggcgatcgtcgggggccagcacgccgtaccggatcagttcgacgaactgacggcgcagctgctcgtacggcggcgtgggatcgtcggtgaccaccgtcaacgccgggcgatcggtcaccgggcccccaccagcgggtcggctcggtccagcggggtcacgagcgcgaccgcacaccaggtcaccatggcaagcgatgcgggaaccacggcaagcagggcccagcccgtgatcgtccaccacgtcggcgcgcaggagatgtcgagtaggccaccggccgcgatcaggctgaccccggcgagcgggatggcgatgagcacgccgaccgcgccggtgacgacccgggccgcgcgcctgcgcagcgcgtcgtcgaccgccaggtcgccggtgctgccggagcgcggtcgccggacgatggtgcgcacggcgaggtaccccatcagcagcccgaccagtacgacgaccagcaggggccaggtatagaacaggcccggccacgggccgtggctctccaccgtgtcggaggtgcactgccgggtgagcgagcgtccggggcggcccatgtcgtcgggaccgccggccgcggtcgtggcggtaagcaggaccaggagcccgccgccggcggcggcgaccacccggctgaggtggcgtggcaggtagtcgcgtatgcggcggacctcgacggccgcggtgcgtgtcggcccgtgcggtggccggatcgtcagctcgccggcgagtacgccgatgagggtgcacagcccgaacagcggtgcggccatcaacagtcctgtgccgaggtcgcccgatcgcgcggcgacgacaccgacgatcacgccgagcgtcacgcccgtccaccgcagcacggcggtgcgtcgggcgatcgccctcgggatgtcgcccggcgcggcagccggttggcgcgggcccctacgcatcaggagcgtcagcaatacaccgcatgccaccaggcccgacagcagtaccaggatcggtagtacggacatgcgcgctcccccgttgtatcaagcgtgtggcacaaggaggatgggcgacgacagacgcttgtgtcaagcgcctggcacattcaaccggggccggcacgcctcaggcgccgccaccgcagcttcctgggcacgcgtcttcaccgacaaggggtccggcaaggcctcgcgctcgacgagctgatcacctacgtccgcgatgacgacaccgtcttcgcgcactccatggaccgcctccccgcgacctggacgacctgcgccggctcgtccggacgctgaccggcggaggcgtccgggtcgagttcgtcaatcttcacgccgtccaaggcctcggcttcaccgtttcagaacggtgaccgagttcttctgcaccactcgggtgatcgggtggtcgtcgccgagcacccgacgacagccggccacggcctgctagctagctagacggcctgttcgaacagcggcatcgcccggcccagatcgccggctgcctggtaggcgtaggcgaggttgttcaccgagcccagcgtctgcgggtggtcgtcgccgagcacccggcgacggtcggccaaggcctgctcgtacagcgggatcgcccggcccagatccccggccgttcggtaggcgccggcgaggttgttcaccagggtcagcgtctgcgggtggtcgtcgccgagcagccggcgccggtcggcaaaggcctgctcgaacagcggaatcgcccggcccagatccccggccgtgtggtaggcgtaggcgaggttgttcaccgagcccagcgtgtcagggtggtcgtcgccgagcacccggcgccggtcggccaagacctgctcaaacagcggaatcgcccggcccagatccccggctgcctggtaggcgccggcgaggttgttcatcgaggtcagcgtgtcagggtggtcgtcgccgagcacccgacgacagccggccacggcctgctcgtacagcggcatcgcccggcccagatccccggcggtctcataggcgccggcgaggttgttcaccaaggtcagagtctgcagatggtcgtcgccgaccacccgacgacagtcggccgaggcctgctcgtacagcggaatcgcccggccgatgacgccttgatcgtgcagaaagttcgcggtctggttgtagagccggctggctgcagcgtcgggttcggggtggttgcggtcgtgctgggcgagggcttcgatatgcggtgtcataacccgccagacaggccaatcctgtggcgtacgccagtcgtcgggtatcgcggtttgcaggtgctcgatcgcgcgggtgcgggcggtgctgatgtcgtggggttgccggtgcgggtcgtccgggtcgggaatgcgtgcgacggcctggaccagccggtgcacgctcacagtgtcctcatcggcggtgatcatgctgtaggcggcgagacggccgaccgcccgggcggtcgtggcggggtcggccagcccgtcgagcagggtgcgggggacggcatccggggcgtaccaggccaggatccgcaggatgtcgccggccagcggcgtatcactgagctggtccaaagtgacacgccacacccgggcgatggtgcgcccaccggcaccttcaccgccctggtcgaacatctgggcgggatactgctgcaacagctgcaggtaggcggcggcggacagacccgtttcggcaaggtaggccgccgcctggtccaccgccagtggcagacagcccaactcccggcacacccgctcaagcccgtcagcatcaccggcacggccgctgccggccaggacctgccgcatcgcctcggcggcgtcatcaaggtcgagcacatccaacgcgatggcggtggcgatacccgcccagccggtggcccgccggctggtgaccagcagccggccggtgccgacacgagccaacaagcgggcgacgtcacccgggtcgttgacgttgtccaggaccaacagccacccgtcgtgcgaggccagccactgcaacgcccgttcccgcagcacctccagcgacaggccatcgggcaggtcggtctgcaaagcggtcgccaacgtggccaacccggcgtcgataccggccgtcgtgtccgcgtcgatccaccacaccggccggtaccggtcacggtgctgccacgcccaccgtgccgcgagggtgctcttaccgaccccacccaacccgtggacagcctgaaccaccgcggcccccggctcggccagcacctcatcgagctgctggagctgcgtgccgcggccgacgaacacacccgccgccaccgccacgttgaccaatccgtccggcgccggcaccgaagacggccgcaccgacatcggcgacacggcggcggcagggaaatggttgtgctggacgttgcggtcacccacctgctgaccctgagcatgggagaccgtgacaccgctgtcaccagccgcctgcgcacccggctggacgtcgccgtgctcccgcaccacagtgctccccctcgtcagccacaacgaacgccgcgcccatcccccacagatcgcgtccgctgcacctctcagcagacgcctacccgctgaacccggcccatcacgcctcaaggatcccagtcgacggccatccggcaacgcaccagcgatgcgtacccgcaccgacaagccatgcccgttccactcccgaaaccggaacgttccggtcgagcgccgcatccggtcatgtcgctgggtcgggttgtcgtcggctccaacctccacgagcggacaccggccgccggcatcgtccgcggagcctggtgggccctggtctcatcgcggcaccggcctgcagactgtgccccatgcctgtacttgatgcccacgaatcgacggcgacgggtagccgactgccctccgttcgcgctctggtggaggagcgcatcatcttcaactaccgtctgcccgccgaccacctggaacgcctgctcccggttgcctggttgaccccgcagctcgtcgacggcgatgcggttgcctcggtgtgcgtgttgcggctcagcaaggtcacggccggccctgtcccctccctgttcggcgtccggagcgtcagtgcggcgcggcgctacggagtgctcgatcagaggtcaggcggccgccctgccgtcttcgtcaccgagcgcacgaccgactcggctctcggctccctcttcaccggggccgggttctcggcccagcacgagcatctgtccgcgaacatcagcagagacggcgagtcggtgctggtcgccttggggaacgaccgcttcaacggtcgagcggtcccggcgcaacgatggtcgtcgtcgctgttccccgcgctcggggacttctcggccttcctggccgaggggatccggagctacggaacgtcccggcacgaagggcagctcaccatcctcgacctgttcaaggaggacaagggctatgaaccgctggccgctcgcgaggtccgtggatcgctggtgcagccctggctggacgccggagccgtgctggacagtgtcgcccgcacaacgaacgcgaaatatcgctggacctaccacggcctcactcccaagccctgagcggtccgcgcggcaccgtgcccggcgacagggggagttcctgtccgcgtcgacgccctcagcgaacttcaaggccgccggtgcgctgacgacatcgtccgcagccggctgctgcaacggacacgggtccaaggctcggcagggcgccgcgaatccccgctcacggcaccagttcaccagtgacgtcgtacaccaggcgggagccgagcggtcggctgagccgcaccggcacgaggtagaacttcttgccggagctgatcggcgttgtcgggcaagacaccgtgcaaccggtaaggacaccgacatacaagtcgaacggcacctgctcattgatccggacgccggtgggcggcgtatcggctcgcaccccgagaatcagccagtcgccggtcttcccggtgagtgcctgccccaggtacaccggcggcctcgtcgcgtcgaccttctggtaacggacgaccttcaccggccgggtcgacttcggcgagccggtgactaccgggggcatgacagctgtcgcctcgtcgacgccgaacgcttcgtacaggtcctcgacggcgggtcgctgaggggtggccgcgggccgcgctccggcgtggccgcctggcaggggtagccccaggaccgcccacgccagcacgccgagcatcacgacgttgccgatgcgggtcagcatgtacgccgcgtcgctcggctcgttcgcctcggggttgcgatagccccaggcgaaaagcttctgccattgggatcgcggcgagatcaccccccacaggagcagcgcgataaccggagtcaaaggaacaagcaggcgatccacggccgaggatgatatctacgaccgccaacccgaaccgctccggtcggctacggaaccccgcccacccggcgtaccggcgtggcgatcagttcccggccggccgggtcgagatcggccggcgacgcctgactttatagacagttgcctattgacaccgttgtcgggtctggcgaacgctgaggctcatgctgaaacccgctcgggtctccgttctcctcaccgtgctgctggcgctggtcgccacgccgggcaccgcgctcgcggcgccgcggcctccgcgggtgcacggacagagtgtgcaggccgggcatctgcgggtgcaggtgctcagcccgacactgctgcgtctcgaatacgccgccgacgaccacttcgaggatcaggccaccttcaacgccgtcgaccgggcaccggggcggacctggttccgggccggcaccgcccacggcgagctgcgggtgtggaccggtgcggtgaccctgcactaccggctggacagcgggccggtgaccgccgccaacaccacgctggacctgaccgtggccgggcgccggaccagtgtgcacccgggcttcggcatgcagccggccgacccgctcggcggttggtaccgggggctggactactacgccgggcaggccgggccggtcgaccagctcagcctgcatcccgggctgctcgaccggcagggctggtatctgctggacgacaccgcgaccgcgctgcgcaccggaaacggccagctgggggcgcggcccgcgcggaccggcgcctatcaggacggctacctgttcggctacgggcacgactacccgcgggcgctcgccgatctgcggacgctgaccgggccgtcggtgctgccgccggagtgggcgttcggcacctggttctcgaagtaccaggcgtacagcacggccgattaccgcaccacgatcctgcccgccttcaagaaccaccgggtgccgctggattcgctggtgatggacaccgactggaaggcgccgaaccagtgggccgggtggaactggaatccgggcctgttcccggacccggacgcgttcctcaagcagctgcgcgccgcgggagtcaacgcgacgctgaacgtgcacgcggcgatcagcggggacgatccgcggttcgcgcaggcgcaggcgaccgcgaaaggcagactgcagccgtcgacgaacagtttcgcgccgaacccgtaccggttcgactggggtgacccggatcaggccgccgccttcgtgcagttgcatcaacccttcgaacagcagggcgtacgacagtggtggctggactactgctgcgacgacagcaccgtcagcacgccgggcgtcaccccggattcctgggtgaacgaactgtaccggcgcgagggtgacgcgcggggcgtccgcggcttcgcgttgtcccggatcggtgcggcgtttcccgcgtacaccgcaatcggcccttccggtccctgggccgaacatcggagcaccgtgcatttcaccggtgacaccgaggcgacgttcgcgacgctcgccttcgcggcggcgatgaccccgggtgagggcgccgccatcgggcagtcctatgtcagccacgacatcggcagtttcgccggtaggcatctcagcgacgacctgtatctgcgctgggtgcagctgggcgcgttccagccgatcctgcgcctgcactcggaccacggcgaccggctgccgtgggagtacgacagcgcggtgagcgggccggccgccgatttcctgcggctgcgcgaatcgctggtgccgtatctgtacaccgcggctcggcagaactacgacaccggactgccgatggcgcgggcgctctatctgaactggccggagcagagcgaggcctatcggcacgactcggaatacctgctcggcgattcgctgctggtcgcgccggtcaccacacccgggctgagcaccaccgcgccggtgtggttcccgcccggcacctggaccgatctcttcaccggggagaccttccgcggaccggtcacccggacggtcggcgccacccccgaccacatgccggtctacgtgcgcggcggcggcattctggcgcagcgcgccggcgacgtgaacgtcgccacgcaacccagggacaggctgaccctgaccgcctacccgcacgggtccgggaccgcctcggtgtacgaggacaacggtgacggcctcggctaccgcaccggccggtcggcgcggatcccggcccgttacaccgagggccggcgggccgccctgaccgtcggaccggtgcagggcacctatccgggcgccccgaccacccggcagtacacggtcgcgttcgccgatgtcgcgcggccgcatcgggtgaccgccgacgggcattccgcggcgtggacctacgaccccgggaagcaccttctcaccgtggccctgccggcgattgccgccgggcgcgcggtcaccgtcgagcacgacggggcgacgttgaccgtggcgcagaagccggccgtcgacaccacgttcaccgcacccgacgggctgcagtccggggcgaccagcaccctggtggcgaccgcgaccaaccacggtccgggcgcgatcaccgacgtggcggccaccgtcacggcgccggccggctgggtggtcaccccgaagtcggcgacgaccgcggcccggctggcacccggcgcgacgttcacggcgacctacgccgcgacaccggccggggcggcaccccggacgcaaccggtgacggtgcacatcgcgtaccgcaatccggatgggaccgcgacgagtgcgcccgccgcgctcaccgtccccctgaaaccggtcgcggtgaccttccgggtgctcgcgccgcccgggacgccgccggacgcgacgctgtacgtgccgggcagcatcgcccagctcggtccgtgggaccccggcaaacaggcgatgaccgaccgcggcggcggcgtctgggaggcgaccgtgtcgatcctggacggcaccgacctgcagtacaaatacacccgcggcacctgggaccgggtcgaggagtgggggtcgatcaccgggaccgacaaccgcagcgtcagcgtcgacggcggcctcagccacaccatgctcgtcgacgacacgtcgaccgcgtggggcgacgcgagcgtgccggacagccacaaggccatccggtactggcgtgatcctctcgtcgtcaccaccgaggcgacggcgcgtgcggtcaccgtccgcttcgaacgcgacatccgtccgaccggcgccgactattccggatcggtcaccgtggccggcccgtccggcacggtcgcgggctcggtcgccgaaccgtcgccgggcaccctggtcttcacgcccggcgcggcgctgccggccggcacctacaccggcacggtcaccggcgtgaccagcgcggtgtcggacggcgtgccgatccagaagccgtacacgttcaccttcgcgatagccccgtgatcgtcgagctcgcggtggtcggcgccggcgtcgccgggtcgccgaccaccgcggctctgctccgccgtcgtctcagtcgctggcgacgtcccggtggatcgcccagaccgcgggcggaatcgccgcgccggtccaggccagcaggtacagcagcgccttgacgttgccgccggaagccattgcgaacgaggcgaacggcaggccgatcgccatccggttgatcaacccctcggcgaacagcagccaggcgaagacgccaccgagcagccacatcggatgccgcagcacggccgtgcacagcgtgccgaacacggccatcaccggcgcgaccaggaccgtcgaccggtactgggcggcgtggccgtcgagcagcaccggcaatccgctgacggccgtcagcaggatgcccagcacggccgcggacacgcactgggcgatcaggacccgccagcggtgcgggtggctcaggtacaccggcacgatggtccggtgctggtagtgctgggcggtgacggtcaccgcgatgccgaaggcgcccagcccggcgaagagcgaccacgcctccttgctgaaccagccgaccagcgcggccatgagggcgaacccgatcagcgccagccacgacgacaggatgctcacgctgcggtacagctcgctgcggacgacgacgatcatcgggcctccgacacactcatgaagatctcctgcaggtgctgggcctcggccaccagctcgaagaccgggaccccggcggcgagcgcgatggtgccggcctgttccgcgctgatcccggagacgaacagcaccggcccgtcgggcgtcactgtcgcgccgtagtgctcgaagtacgccgcgagccgggccggatcaccgccgcgcacccggagccgctccgtgccggccagctcggccagcgttccggacgccaggatccggccctggccgatgatcaccacgtcatcgacgaagtgctccagctcggcgagcagatggctggagatcagcacggtccccccgtccgccgcgtgtttggtcagcagctcgcgcagccaggccatgcccggcgggtccaggccgttgaccggctcgtcgagcacgagtaccgagggctccccgagcagggccgtcgccaccgccagccgctgcttcatgccgagcgagtagtcgccggtccgcttggtggccgcgtgccccaggcccacgtactcgagcaaccggccgacccgctcgcgggggaaaccgccgagcagcgcctgggtgcgcaggtgggcgtacccggactggccgggatggctcagaccctgctcgatgaccgcgccgacgtggcgtaccggatggtcgagttcccggtagcggcgaccattgatcagcgcgacgcccttggtcggccgggccaggcccagcaggatccgcagcgtggtgctcttgccggagccgttgagcccgagcaggccggtgacccggcccggcgcggcggtgaacgtcacgtcgcggacggcagccacctgcccgtaggtcttcgtcaggtcccggatctcgatcatggcgggaattatcccggccggtgtcaagtgccccacggtaactgttcgaccaccaatcccggcggggtcgaggcattccgcatgatccgatacggtctccggatgtccggtgaactggtgaccaaggccatcgatctgctctgcagcaactacatcttcgccgacaaggcgcgcaccgcggccgacggcatccgcgcccgactggccgccggcgagtacgacgggctcaccgaacaggccctcggcgagcgcttgaccagcgagctgttcgcggtctgccaggacagacatctgcgggtacgggtacgggacgagagcctgcacgacgcgctcaccgaggatgaggtggaggcggcctggcgcgaacaggaccggctcggcaaccacggcatcgcccgcatggaacgcctcgacgggaacatcggtctgctcgagctgcgcgccgtgaccgcggccgacctcgggggccgggcgatcgcggcggccatggaactggtgtcacacacccatgccctgatcctcgatctccgcaggaaccggggcggatccccggacggggccgtcttctggtgcagctacttcttcccggacggggaaacccacctcaacgacatctacgagggggccaccggccgcacccgccagtactggagccacgcctggctgcccggcgagcggtacgtcgaccggccggtctacctgttgaccagcggaacgaccttctcggccggcgaggagatctgctacaacctgcaggcgcagaagcgggcggtgctgatcggggagaccacccggggcggggctcatcccaccgaggcgttccccatcaccgccaccttcgagatcacggtgccgacggcgcgctcgatcaacccggtcaccgagggcaactgggagggcaccggagtgatcccggacgtggcggtgcccgccgcggaggccttcgacgtcgcctaccgcacggcgctgcggcacgtgctgacgacctccgccccgccggccgtgctgaccgaggcgcgagccgccctggagaggatcccggacggtcgagacgcgcgggcgtgatcatccccagcggaggcggaggatcccatgggcgcgaagaccgcactgcttgccttcaccacaggcgatctacgccccgcgctgcgcgaagcggtggacgccgaccccgccgaggcgctcgcgctggtgcgcggattccaccccgactacgacgtgacgccgatcggtgacggcgtgctcggagaggacgtctacccgccggatgacaccagctacgcgacggtgctggtcggggctgagctgttgtgcgatcgccgcctcgtcggcgaccggccgtcgcagctgccggcccgtctgctccaagcgggagccggccgccggatcatcatgcacggaatgcactcggtctccgattggctgtgcttcgcggtctgggagaacggctcgctggtccgttcgctgagcctttccccggatggcggcatcgtggagaacatcggcgagccgtacgatttcgagcgaccctattgggcgggcgagcggccggccggcgcgacgttcacgggagatccgtatccgttgccgtttcacccgctggagctgggtgaggacgccctgcgcgcgctgttcggcttcatcctggaaggtcttcgggacccgagcgacgtcgatccgtacgaggttccgctgcgcggcttccgggtggccgacccgaccggccgggagcaggcggagcgcgaggccacgatggagcggctactgcgacagatggggccgccacgccgtttccgcatgaagcccgacggcaccttcgaggagatccgcgacgctgaggcatgacctcgcagcgctcgaccatcgaccggattagctttttgacgtgctgggtaacagggcggtcagcgggagacacccgctgacgaaacggagcaagtcatgctgaccttcgggctcattcttctgctgctgggcatcttcctgcacgtgtcgatcctgtacacgatcggcatcattctcctggtggtcggtgccgtgctctggatcctcggtgccgtcggtcgcccggtcggtggtcgaaaggtctggttctagccttaccggccaggcgatgcggaaagggcgccccaggagtgggcgccctttcgcatgtccgcggccgtgggcgccgcgaagggcgccggcatcacccggggacactggcgacactcccccgtgtcatgatcgcggccgtggatgagtgggtcttcaacgagcggccggccggcgtgcggttcctgaccgaccggatcgatgagccgggtcggacccgggtcgaggacgagatctggagctggatcgtgcgcggcgagaccgacgcggccgatttcgtggactgcttcgatgtcgaggaggaccggcacggcgccaccgacgaggagctggcggcggcgtacggccgggcgctcgacgcccggcgggcgcagcagcgcgcctgggggccggtgcgcaccaatctgaccagcgcgttcgccgagctcaacgagctgggtgtggtcgcgcgggagaacttcgcctgctgcggcacctgcgctgccgcggagatccacgacgagcgggacggcagccggcactggcgcggctacgtctggttccaccagcaggacaccgaggcgctggcggagagcgcgaacggctcggtctacctcggctacggcacctgggcgccggagaatctcgaccgggccgcgtacgacgatctctcggccgccgagcgccaggcccggtaccgggccgacgtggagcagatgctggacgagatcgtcttcccggtgctgcaccaccacggtatgcaggtcacctggaaccgcagcctggccacgcgggtgcacgtcacgggcgcccggtggtacgccgcgctgccgtaaacggctggtggtccttgaggtgcactgccgaccagtgtgccggcggcgggttcgcgaagcagccgtgttcaggtgagttgttggcggatccggcgggccgggttgatgaggtggaggtcgagcaggccgggcgggtcggccaggccggggccgcccgcgtgcacccaggcgatgatgtcgtcggtggcgccggggtcgttgaccaggccgagccagacgggccggccgccggcacgccgcccttcgggagaaggttgcacgacgatgacgttggcgtgttcgcacgcgtcgaggcagccgctgacccggacctgcgccgccccggccagcgattggcgcagccgggccagttgagcggcgtggtcgatggcgcggacctcgggtgtgccgcagcagcagccgcggcacacggtgacggtgcagccgggtggcgtcccgccggcggcggggcggggacggcggctcacgccgcggcccccttggtggcgtggcgccaggccctggccgacagcagtcgcaggccgttgaggccgacgatgacggtggagccttcgtgcccggccacgccgagcggcagcggcaggtggccgaacaggtcccagcagaccagcacggtgatgaagctcgccgcgatgatcaggttcgcgaccaccaggcgacgggcacgccgggacagggcgatgaccgccggcagagcggtcaggtcgtcgcggaccagcaccgcgtccgcggtggacagggcgaggtcggagccgcggccgcccatggcgacacccaggtcggcggcggccagggcgggggcgtcgttgacgccgtcgccgaccagcagcacccgccggccgccgtcctgcagggtgcgtacgcgctcgaccttgtcggcgggcagcaggccggcgtgcacctcggtgatgcccgcctcggtggccagacgcgctgcggcgcccgcgttgtcgccggtgagcagcaccggccgggcgccggtgagctgagccagggcggtcacggaggcggtggcggcgggccggatgcggtcggccagcccgatgaccccggccggcctgccgtcgaccagcacgatcaccgcggtgcggccggcgtcctgggcgcgggccgtggtggcgcggacctcggcgacctcgtcgcggtgtgcggtgacggtgtcgagcaggaccgggctgccgacctgtaccagccgtccgtcgacgagcgcgcgcacgccgcggccgggggcggaggcgaagtcctccgcgacgggccggaccagaccgcgttcgcgggccgcggacaccaccgcggccgcgaccgggtgctcgctggcgtgttcggcggcggcggccagacgcagcagatcccgctcggtgaacgggccggccgggtggatctcggcgacgcccggcgtacccgcggtcagggtgccggtcttgtcgaacgccaccatgccggtgtcggcgagccgctccatcaccaccgcggacttcaccagcacaccgtgccggccggccagggcgatcgacgacagcagcggtggcatcgtggcgagcacgaccgcgcagggcgaggcgacgatcatgaaggtcatcgcccgcagcagcgtggttcgcgggtccgcaccggacagcagcggcacggcgaacagggcgagggtggcgaccacgacgccgagggagtaacgccgctcgaccttctcgatgaacagctgggtctcggccttgctggccgaggcttcctcgaccagggcgacgatccgggcgatcaccgactccccggccgccttgtcgaccctggccagcagcgtgccggtgccgttgagggtgccggcgaacacctcgtcaccgccggtcttggcgacgggcagcggctcaccggtgatggtcgcctgatcgacctcgctggccccgtcgatgactcgcgcgtcggcgccgatgcgttcgccgggacggatccggatcacgtgatcgacctggagctcaccggtgggcacgctgtgctcggtgccgtccgcgtcgacccgggtggcccgctcgggggccaggtccagcagggcccggacgctgtcggcggtgcgggcggtggcgaacgcttcgagggcgccggaggtggcgaagatgacgatcagcagcgcgccgtcgaagacctgtccgatggcggccgcgccgatcgccgcgacgatcatcagcaggtccacgtccagcgtgcgctcccgcagcgcctggagcccggccagggccggttcccatcccccggcggcgtagcaggccagatacaggacccaccacagcggcgtgggcgcgccggccagctgcgtgatgccgccggcggcgaacagcagcgtggccagcgtcgcccagcggatctccggaagcgcccccatccgggagaccaaccgccgtttcggcgcgcccgcggccggatgaggcgcggcggtggacggggtcatcgtcacagtcacggcaaccacgttacatgcgtaggcacgcaggtacgcaaccagccaggcagatgggtatggtggtatcggttacgctgatgccgtgcacacctcgctgccggatttccggatgcccgacgacgagcaggttcacctcgccgccgagggtttccggctgcttgccgacccgacccggatcaagatcctgtgggcgctgctgcagggcgagtcgtcggtggcatgcctggccgagatggtcggcgcggcccccaccgcggtcagccagcacctggccaagctgcggctggccgggctggtgaagggtcgccgggaaggcacctatgtgcactactcggctgccgatggccacgtgcgggccctgctggccgaggcgttgttccacgccgaccacgccggggcgggcatcagcgacgagcaccggtaaccggcgccgcagccccgcctcgtcgagtctcgacaactccgggtgcggtgctgcccgggcccgagaccggtgggcagcaccgcacccggagttcacctaccggctgatggtggtgaaccggcgcagccggagactgttcgcgaccacgaacaccgacgagaacgccatcgccgcaccggcgatcatcgggttcagcagcccggccgccgccagcggcagcgcggcgacgttgtaggcgaaggcccagaacaggttgctcttgatgatccgcagagtacgccgtgacagccggatcgcgtccacggcggcggtcaggtcaccgcggaccagggtcagatccgaggcctcgatcgcgacatccgtaccggtgcccatggccaggccgagatcggcttgagcgagcgcggccgcgtcgttcacgccgtcaccggccatcgccaccaccttgccccggtcctgcagccgcttgaccacctccaccttgtcggcgggcagcacctcggcgatcacctgatcgatgccgacttcggcggcgaccgcccgtgccacggtctcgttgtcgccggtcagcagcaccggggtcaacccgagccggcgcagcgccgcgatcgcgtcgcggctggtgggcttcacgacgtcggcgaccgccagcacgccgcgcgcctgaccgtcccagccggcgaccaccgcggtccgcccggcctgctgcgccgcggtcaccgcctgttcgacgtcggcgggaacggcgtagtcgtgctcgtgcagcaggcgtagccggccgatcaacaggtcgcggtcctcgacggtgccgcggacgccgaggccttccaggttggtgaatccggcgaccggcgccagcggtgcccgctcggcggcggcccgggcgaccgcctgagcgatcgggtgctcggaggcggcctcgagcgcgccggccaggcgcagcagctcctcacggtcctgaccgtcggcggggatcacgtcgaccagggtcatccggccggtggtgacggtaccggtcttgtccagcacgaccgtgtcgacggcgcgggtcgactccagaacctgggggcccttgatcaggatgcccagttgagccccgcggccggtcccgaccagcagcgcggtcggggtagccaacccgagtgcgcacgggcaggcgatgatcaggacagccaccgcggcggtgaacgcggccgtccagccggagccggtgccgacccaccagccgagcgtcgccgcggccagggcgatgacgatcggcacgaagatcccggagatccggtcggcgagtcgctgcaccggcgccttgccggtctgggcctgctcgaccagcttggccatctgcgccagctgggtgtccgcgccgacccgggtggcgcgcacgatcagccggccgccggcgttgacggtcgcgccgaccacgctgtcgccggacctgacctcgaccggcacggattcgccggtgagcatgctggcatcgacggccgaggtgccgtcctcgacgacgccgtcggtggcgatcttctcgccgggccgggccacgaaccggtcccccactctcagttcggcgaccgggatgcggtgttcgacgccgtcccgcagcacggtgacgtccttggcgccgagttcgagcagggcgcgcagagcggcgccggcgcggcgcttggagcgggcctcgaagtagcggccggcgaggatgaaggtggtgaccccggcggcggcttccaggtagatggctccggtgccgtcgccgcgcccgatggcgagtgcgaacgggtgcgtcatgccgggggtgccggcagtgccgaagaacagcgcccacagcgaccagccgaaggcggcgacggtgcccagggagacgagggtgtccatggtcgctgcgccgtgccgcaggttggtccaggcggccctgtggaacggccagccgccgtagacgacgaccggcgcggccagggtcagcgacagccactgccagtaggtgaactgccaggccggcaccatggccagcagcaccaccgggacgctgagcaccagggagatccacagccgggtccgggcgtcgtgcagttcgtcggccggttgcgtcggctcggcccggtccgcaccggccggcgcggggggcggcggcagcgcggcggtgtagccggtcttgtgcaccgtggcgatcaggtcatcggcggtgacgtcgccgctgtagctgaccgaggccttctcggtggcgtagttgacggtggcggtgaccccgtccatgcggttgagtttcttctcgatgcgagcggcgcaggaagcgcaggtcatgccaccgatcgacagctcgacccggttcggggccaccggcagtggcccggcgacggatgccatcggatcctcctaatcgtggttatggccgtcggcgccatgcccggccggactcgacggtgcgctgacgggcggaccggccacggcggtgaactccgcggtgtgcaccgtcccgctgtgctggaagtccaggtacagccggtacgtgccggcggacgggacctcggcgtggaagacgacctccggaccggccgcggtgcgtccgtcgcccggctcgccgtccgggtgcacgtgcaggtaggccaggtcgccggcgcgcagcgcgaccaggtgcccgtaggcgcccaggtacggctgcaggtcggtgaccgggcggccgtcccggctgaccgacagggccagccgggacgaggcgcccggggcgaggtcgccggcgagcgtgacggtgtagccgtccaccgtcgcggtacgggcggccgccggcagcggcaccggccggtagtcccccgcggcgggcacgtcggcccccagcgtgatcccgtcgtgcccgatgggctggaagtcggcgaacacccggtactgcccggcggtgggcacggcaacgggaatcgaccaggtgccgtcgtcggccagtcgcgggtgcacgtgctggaaaccggacaggtcacggcggaccacgatcaggtgcaggtccctgtcgtggctggtggtgtagccgatgaccggcctaccgtccggcccgatgatctggaagcggaactgccggggtacgccggtcgacagcacggtggtgagcggagtgagccggtatccgtcctgggtgacctgcagcccgccgggcagcgcggcgaccggctcggccgccgtcccgtcgtgcccgtgggcggctgtcgccgcggcgtggccatgggcggccggcgccgaagccggggtgtggccggcgatgcggccgaggccgagggcggccgtgaacacggccgccagcccgatcccgaagccggccagcttcacagcggtgttcatgacctacctcgccaaccggtagccggcctcgtcgacggccgcggccaccgcggcctcgtcgagagatccgtcgctggtgacggtgaccgcgccggaggccagatcgacctggacggcggtcacgccgggcagccgcccgatctcggcgctcaccgagttgacgcagtgcgagcaggtcattccggtcacggtataggtctcggtggccatcacgatctcccttgcggtgtgtacgggcgcggcacgacgccgccggcctcatcgtcacgatacccatacccccttggggtatcaacgacgggccgggtgatcggcaacacccggtgcacgttcgtggcccgcggcgatgaccatgcgggcgggccgagcaggagcatggcggtgcgccgagaagattcccgacgtgaccaaccgtctaagcagcggtgcgtccggcgcgatgcgacgtttcgccgggtggatggcgcgcggctcggtgggccatcccctaatccgacgagcggtcaaccggtgatcgtccgggcctacggcaccagccagcgttccagggctaccaccaggtcaaacagcgcggtgctgagcagggccggcagggtgctcgcggcgaaggcgagcggggtgtccagggacatgccggacaggacgatgagcgagccgaggccgccgctccggttgctgatctcggcgacgacggcgccgatcgcggccgcgatcgccctctatgtgcggagcatcgcccggcagcgggcggaagaaggcgtcggcggccgggtcgccggcaaccatgacaccgtcaggcagcggcatcagcccggctccgactcgtgcccggccggatgtgagcgcagcagacccgcgtacgcccgctccgcggtgatctcgccggtcacgacccggtggatggtccgggtgatcggcatcggcaggccgtgccggtcggcgagccgcaccgcggcgtgcaccgtcttgacgccctcggccacctggcccatctcggccaggatgtcgtccaggccgcggccgcggcccagctgctcgccgacgtgccggttgcggctgtgcgggctgatgcaggtcgcgaccaggtcacccatcccggccagcccggccagggtggtcgcctcgccgcccatcgcgacggccagggtggtcagctcggccagcccgcgggagatcacgccggcccgggtgttgtcacccaccccgaggccctgggcgatcccggtggcgatcgccaccacgttcttcagggcgccgccgacctcgcagccgatcacgtcgtggttggtgtagacgcgcagcagtccccggcggaacacccgctggatctcggcggccacggtcaggtcctcggtggcgatcacggtggccgccgccatccccgacatgatctccttggccaggttcggcccggtcagcgcggccgccggatgcccgggcagcacctgcttgaccacctcggtcatccgcagcagcgagtcacgttcgagacccttgctgaggctgaccaccgggatccacggatgcaggctgggccggacactctccagcgtggcccggaacgccccggtcggcacgccgaccaccagcagctcggcgtgggccgccgcctcggcgagatccgcggtggcccgcagccgggcgggcagccggaaaccctggagataccgatcgttggtgtgcttgacgttgatctcgtcggcggtgtccgggttgcgcgcccagatcagcgactcatgatcccggcgggtgagcacggacgccaccgtggtcccccacgatccggcgcccagcacggtgatccgcatgcgtcggcccccttccggcgcctagagcatacggccgatcaggacaccggtacccgtaccgcgccgctcaggatccggtatcgcgccttctccatgcccggcacgtacgggcccagggccttgttggaggtggcgtagccgacgccgtcgaccttgaggtcgtagcgtttccggccgccggcccggtcgcccttgacgaaggcctggatctcctggaacacgccgttgtcgacacgcttgagcatcgaggtcaggatgtgcgggcgcaccgcctcggcggcggtggcgtactggtcggagtcgacgccgatcgtccagacgtgcccgggcgcggccgtcgccgcctcgaacaccccggtgcccgagccgccggccgccgcgtagatcacgtccgccccgccggcgatcatctgctgggcggcggccttgcccttggccggcgcgctgaacccgccgaagtcgggcggcttggtcaggtagcgcacgtccacctggacatcggggctgacgctgtgcaccccggcgacgtagccggccgcgaacttgtggatcagcggcacgtccacgccgccgacgaaacccacccggtgacgtttggtggccagcccggccgcgacgcccaccaggtacgagccctgctcctcggagaacagcagcgcgaccacgttgtcggcggtcaccgagtcgtcgtcgatgatcgcgaacagggtgcccgggaactccttggcgaccttgccgaccgccgcggcgtacaggaatccgaccgcgatgaccgggttgctgccgccggcggccagcccgcgcagcgccgccgcccgggcgtcgtcgctctcggcctgcgtcttggcctccgaggcttcgaccagcagctcctgcttggcccggtcgacgccggccgccgcggcgtcgttgaaactcttgtcgccgcgcccggcgctgtcgtacgcgatcccgacgtgcacgctctgccggccgaggccggaagagtcggccggggcgaccgggaccatggccgccgagcaggccgacagcagcagggtgagggccgcgccgagcaggccggtggcggtgcgcttgctcatgtgtcccgtcctcagtaccggaattgggcgaccgcgtcgcgcaactgggcggacatgcggctcagttcggcggccgcttcccgggagcgggccacctcggccgaggtggccgcggaggcggcggcgaccgcccggatgttctcggcgatggtggcggtgccaccggccgcggccaccgcaccccggttcatctccccggtggtggcggtctgctcctcgaccgcgccggcgatcccggtctggtagtcgctgatccggcccaccacctcgccgatcatctcgatcgcggtgaccgccgcaccggtgtccgactggatggcctgcaccagcgcatcgatctcgtcggcggcgcgggcgctctcctgcgccagatccttgacctcgccggcgaccacggcgaagcccttgcccatgtcgccggcccgggccgcttcgatggtggcgttgagtgccagcaggttggtctgcgcggcgatgctggtgatcagcttcaccgcgtcaccgatcgcggacgaggaggtgcccaggttggccacggtccggttggcggagtgtgccgcggccaccgcctcggcggccaccgaggccgcctccgcggcattgcgggagatctcctcgatcgacgcgcccatctgctgcgatccggcggccatcgtgtcgacgttgcggttgacgtcctcggccgccccggcgaccaggccggcctgctcggaggtgtcgccgaccgacttggcgaaggcgccggagacggcgtccagctccgccgacgtgtgagtgaggatctccgcctgccgggccacgtcggagacgatggtgcggaccgcgacgaccgcctcccccagcgcggccgacatctgggcgacctcgtcgcggccgctgtccgccggcggctcgacggtcaggtcccggtcggccatccggcgcagcgcgtcccgggccgagccgaccggccgcacgatgctgcgggtcaccacgaccgcggacagcgcgccgagcgccagggccagcccggtcgcgatcaggatgaccagctcggcgcggcgggcgtcgtccgccgacgagcggaccgccgccacgctgcggtcgtcgaccgacgcggccagccgctgcgcggacaccatgatccggtagtagctgttccagctgtcgtacagggcgatctggtcggcgttccagagcgctttcggggtgcccgggcggtatgcggcgacgaccttgtcgttgatgtctacgtacgtggccagctcggtggtgagcctgttgaagacgtcgcgttcggcctcggtcatgctcgcggtgtcgacctgtgccaggaatccgcggaacgcgtcccgctcctgctgccaggccttgtacgccaccgagtcgccgcccagcgcgcggccggccccgagccggtagatgtcgttgatgaacccggcctgccagccgttgagcgtggtcgcatgggtcttgatctcgccggcctggcgggtgagcagttccagccggcggacctgggtggcagcgtcacgctgcgcaacgatggtcgcataggcgaccacggcaacggcgaacagcagtgccagcaccacggcgaaggcgccgaacagccgggcaccgatgctgaagcggcgcacagcggcgtccttccgtcggaatgggcctcaccggcttgatcggcatcagacggaccgtgcttagcggttggggcgatcacttccgggccgggatacagcgacgggccccggcagggttgccggggcccgtcggacggaaacgtcagatgatcgcgccgtcgaggcgggagcggagcttggcgagggccttggtcagcagccgggagacgtgcatctgggagatgccgatctgctcggcgatctgcgactgcgtcaggttgccgtagaagcgcaggctcacgatcttctgctcgcgctcgtcgagggcggccatcgccgggcccagggcgatgcgcagttcggcctcctcgaagccggcatccatgccgccgagggtgtcgccgagctccgagccgttctcgctgaccggggtggacaggctggtcgagttgtaggcgcgggcgccctccaggccctcgatcacctcgtcctcggtgatgccgagatgctcggcgatgtcggcgaccgtggcggagcggcccagcgtgtggctgagcgtgttgttcgccgtggtgatcgccaggcgcagctcctgcagccgccgcggcacccgcaccgaccaggtcttgtcccggaagtagcgcttgagctcgccggcgatggtggggatcgcgaagccggcgaagtcgacgccgcggtccgcctcgaaccggtccaccgccttgatcaggccgacgacggcgacctggtggaggtcgtcgcgcggctcgccccggttggcgtaccggttggccaggtggcgggccagcggcagccacgcctcgatggcccggtcgcgcaggccgggccgggacggatgtccggccgggagcgccgccatcgcggtgatcagctcactggccgggtcggtgctcgccgcggcgtcgacgtgggttgcggtctcagcgatgacagtcatggatgttgcgctcctcggctccggtcactgcgggagcaccattgccccgccacgtagctgccttaaaccaccctttcggctgactattcctggcccatcggcggttgcgcgagccagcgttcgatacacgcgagcagatcttcggcatcgaccggtttggtgacgtagtcactggcgcccgaggacaggctcttctcccggtcgccgtgcatcgccttggcggtcaccgcgatgatcggcagccgggagtactttggcatggcccggatcgccgcggtcgcggcgtacccgtccatctccggcatcatcacgtccatcaggatcaggtcgacgtcgtcgttctgggccagcacctcgatccccttgcggccgttctcggcgtagaccacctccatgccgtgcagctccaggatgttggtcagcgcgaacacgttgcgcgcgtcgtcgtcgacgaccagcaccttgcgcccggacaggttgccggcggcccgggtcagctcggccatcgactcgatcggccgggtcgccggcatcaccggctgcccggtttccgccgacatgtgcagcgtgatccgttcccgcaggtcgtccaggctggacagggtctccagcggccgggtctgggcgaacgcctgcagcagggtgtcgttgcccagcggcgcgtgctgggtctggtagaccagcaccggcagcgtgcgcagcccggtctcgtcgtgcagcgccttgaggaagccctgcagggccgggtccagcaccaccaggtggaaggtctgcgaccgcagctcggcgatcgcggcctccgggtcgaccacggtgaccacctcgaacatgccgtgggtctcggcaagcgtggtggcggcgccccgggcgatcaacgtgagcaggccctccggatgcggctcgacgaccagcaggcggcgcggcccacccggtccggccggcggcatggtgaccagcgggcccgggttgaaggccggctcggcgatcgacgcgccggccacggtcgccgactggaccggcatgtagagggtgaaggtgctgcccttgcccagcctgctgcgggcgctgatctcgccgccgagcagccaggcgatctcccggctgatcgacaggcccaggccggtgccgccgtagcggcggctggtcgtgccgtcggcctgctggaaggcgtcgaagatcgcggtcagctgctgctcggcgatgccgatgccggtgtcgaccacccggaacgcgaccaccgtctgctgctcggccagggccggcgacagctcctccggtcgggccaggccgatctccagccgcacccggccctgctcggtgaatttgaccgcgttggacagcaggttgcgcagcacctggcgcagccgctgctcgtcggtgaccaggagggtgggcacgtcggcggcggtggagacctcgaagtccagcccccgggaggtggtcagcgggcggaacgtcgcctccacgtagtcgagcaggttgcgcagctcgaaggcttccggagcgatgtccatcttgccggcctcgaccttggacaggtccaggatgtcgttgatcagctggagcaggtcggtgccggccgagtggatgaccgtggcgtactccacctgcttggcactgaggttgcgggtcgggttctgcgcgagcagctgcgccaggacgagcagcgagttcagcggcgtacgcagttcgtggctcatgttggcgaggaactccgacttgtacttggaggcgagcgccagctgctgggcgcgggcctccagttcctggcgggcctgctcgatctcggaattcttcgtctcgatgtcccggttctgccgggccagcagcgtcgccttgtcctccagctcggcgttggagcgctgcagctcctccgagcgggcctgcagctcctcggagcgggcctgcagctcggcggcgagccgctgggactcggtgagcagcacgtcggtgcgcgcgttggcgaccatcgtgttgacgttgacgccgatcgtctccatcagctggttcaggaagtcgtggtgcacctcggtgagcggcttgacaccggccagctcgatcaccccgaggacctgctcctccaccatgatcggcaataccaccacctgcatcggcgccgcggatccgaggctggaggagacgaggaagtagtcggccggcacgtcgtcgaccacgatccgtcgtttcgccagcgcggcctgtcccaccagggactcgccgaaggcgaaccgcagtccggcgccgacgtgcccgtaactgcccaccacgcgcagctccgcgcccgccgtgccgtcgtcgaccagcaggaacgtgcccagctgcgcgtccaccagcgggaccagctcgttcatcaccagcgaggcgaccacctcgaggtcgcggtggccctgcatgagcgaggagatccgggccaggttggtcttgagccagtcctgctcctggttggcccgggtggtctcgcgcagcgactccaccatgaagttgatgttgtccttgagctcggccacctcgccggaggcgtccacggtgatcgaccgggtcaggtcgccggtggcgaccgcgctggtcacctcggcgatcgcgcgcacctgccgggtcaggttgccggccagctcgttgacgttctcggtgagccgcttccaggtgccggagacgccctccacctcggcctgcccgcccagccggccctcgctgcccacctcgcgggccacccgggtcacctcggcggcgaagctggacaactggtcgaccatcgtgttgatggtggtcttgagctccaggatctcgccgcgggcgtccacgtcgatcttcttggtcaggtcaccctgggccaccgcggtggtcacctgggcgatgttgcgcacctgaccggtcaggttgttcgccatcgagttgacgttgtcggtcaggtccttccaggtgccggccacgttcggcacccgggcctggccaccgagctgtccttcggtgccgacctcgcgggccacccgggtcacctcgtcggcgaacgcgccgagcgtgtcgaccatcgtgttgatggtctgtgccaggacggcgacctcgcccttggcctccacggtgatcttcttgctcaggtcgccctgcgccaccgcggtcgccaccagcgcgatcgagcgcacctggttggtcaggttggacgccatcacgttgacgttgtcggtcaggtccttccaggtgccgcccacgttcagcacccgggcctgcccgccgagccggccctccgtgccgacctcccgggccacccgggtcacctcgtcggcgaacgcggagagctggtcgaccatcgtgttgatggtctccttgagctccaggatctcgccgcgcgcgtcgacccggatcttctgggtcaggtcgccgcgggccaccgcggtggtcacctcggcgatgctgcgcacctgcgcggtcaggttgtcacccatgacgttcaccgactcggtgaggtccttccaggtgccggagacccccttcacgtcggcctgcccgccgagccggccctcggtgccctagctagctagggtgctcttgagctccaggatctcgccgcgcgcgtcgacggtgatcttctgcgacaggtcaccgcgggccaccgccgtggtcacctgggcgatgttgcggacctggttggtcaggttgccggccatgaagttcaccgagtcggtcaggtcccgccaggtgccggccaccccgggcacctcggcctgtccgcccagccggccctcgctgcccacctcccgggccacccgggtcacctcgtcggcgaacgacgacagctggtccaccatcgtgttgatggtgttcttcaactccaggatctcgccgcggacatccacggtgatcttctgcgacaggtcgccgcgggccaccgcggtcgccacctgcgcgatgtcgcgcacctggtcggtcaggttgccggccatcgcgttcaccgagtcggtcaggtccttccaggtgccggagacgctcggcacctcggcctgcccgcccagctgaccctcggtgcccacctcgcgggccacccgggtcacctcggaggtgaacagcgacagctggtccaccatgccgttgaacacggtggcgatctcgccgagcagcccgtcgccgtcctcgggcagccgggtaccgaagtcaccgtcgcgcaccgcggtcaaaccggccagcagctgccgcagatcccggtcggccaccgccgcacccgccgtctgccggtgcactgtcatctcgtcgcccacagcactctccacgctcacacccggcaaagtcggacgtaagtatgcatgccctcgcacaggagttcggcctgggtcacctggtcattcgcgacgggccgtacctcagcgtggggtgaggatgtcggtgtagaccacgcggcgcaccgtgccgttgtcggtggggtgcagctcgtactcctggacgacgatccggtgcgcctcgccgggccgcggcacccggcccgtccaggcctgcccggcgccggcggcgatcggggacagctcgaccggcgagccgagcgcccgccaggtcagttccgggtcggcgatcgcggtgcggccctcggcgaacgcgcacaggtgggtgaggtcgcggtcgtcggccttcccggcgtgaccggtgacggtgacgacgtagtcggagccctgccgggtcaccgtcgcggtgcgcccgttgacgagctggctgaagtcggcggcgacgaccggcgacagcaggcagtccggcagcgcgttcggctggtaccgggccagcgccagccgcacgaacggcaggttcgcgctgagttcctcgtcgtcgtggtcggtgatccggatatcggcgtaccagaggtcgcgggccgggtcgaaggccaccttgtgcccggccacgtgcgcactcccgccctccaccggcagcatctcggcggtcttgacggccagcgggaaggacgacagcatcggtcccgcgacggtccgcggcgcggtggtcaccgggtcggcggcccagtcggtccgggttccgccgaagccgccctgcggttcgacctccgggtaggcgtgcaggaccacgccgagcagttccccgtcgccccaggaccaccaggggcgttccaggtacacacgcaggccgccgccgagccgccggctggtgccgggcaccgagtcgtcccaggcgaaggtcggcaccacggagtggatccgcggcggggcccgcgggaccgagctgagcacgtccacctcgatgggcgcgctctcccgggtcaacgggccgcggaccaggctgaccacgaccttggcgccctccgcgatccggccgccggcggtgcggtgcagcagccggcggtccgggtcgaccaggaagtccccggccgccctggccgggtcggtgacgccgctgggcgcgggggcgaagacggcaccggtcagcgcgtcacgcacccggacggtgaacggctcggtgtcgccggacagccgggccggggcggcggtggacagccgtaccgtcgtctcctcccggaaatgttcgacgaacggcgaggtggcgacggcggtgtaggagacccggcggtatcggtggtcggtgaagtggtgggtgccgccgaccgggagctggacggtgtccggcgccgcaccctccgggtgggtgaccttcaccgagtaggcggtgctccggaaatcccgcgcgatgccgggatcggtgtcgaagcccgggccgtcgtcgaccggcatccgccaggcgccgcgcacgtccagggtcgccgtgctcttctggctgatctccatggtcgcggtgatcgtggccggggcctcgccgaacagccggtcggccttgagtgtgagccagcgcggggcgggcagcggcgtgcggaccgcgtggaccagcatcaggtcgcgggccggggtgagcggccacagccggccctcgcaggcgtcccggcgcagcgtgtcgacgtcggcatcggtgccgacggccgaggtccgcatcaggtcccagacgcccatcacggcgaggtcgtccgggtcgaaccgggacgagatccgcagccggtagatgtcgcccggctccaggcccacctcgaggatccggccgcggccgcgccagccggccccgccgggcggcaccgggcgcaggtccacccggaacgagccgtcgaggtcgacgaccgtctcggtggtgcgtcccggcaggccgcgcaccagggcggcctgcgccagagcatccaccaggtacggcgggtcgagcagctcctgcggatagcagtcggcgtcctcggcccgcaggtcggccaggtcggcgtcgtcccgggcgcgcagcgtctgccaggcccgcgggtccggcgtgccggcccggccgcggtcgagttcgccgtgccactccagcatggtctgcgcggtgcgcggcggcaccacgtgccgggaggagaccgggcgcgactcgtgcacgaccgcgtaccgcggcccctcggccgggccgggcggctggcgcggcaccacggtgggcgcctccaccgggtcgtagcgcaggaaggtggccgccggggtcaccatgtccggctcgccgagatcgtcctcggtggccgccacgccggcattgccgagatcgacggtacgggcccggaaccggtagctgtgcccgaaccgcagccggggcaggctgccgggtggcacccggaagcgggtgccgaactggtacgccgggtcgatgtcgccggccgcgtcgcgcacccggttgtcggtgccgaccggccgggtgagcggttcgacggcgaggctccagccgctccacgacatcatcgactcggtgatcaggtggtcgccgggcacgtcgtggtggtccgcgtccttgcccctggtggtcgcggtgacgacggcggcctcgtcgtacaccgtgacggtgcccttcccgggcagccggtggaactcgtagaagccctcgcggcacatcaggctgcgccacggaccgtcgccgtcccgcacgtcccagcgcagaccgcggaccaggtcctcggcgaacaggaccgggtccgcctcggtgcgccggtcccggaggcggtcgacgagctcgccggcccggtcgtccttggccaccgtcatcgggccggtccgcagcgcgggcagcgcctcgcgccggtcccgggccgccaggtcccggtcgctggcgccggtcagggtggcggcgaactggttcaccgcctgcgctccggcgtccgcatccaggcaggtcacgctgtacgtgtcggcggcgaaccggatcagcccggcaccgaccccggcgccgcggggcgccggctcgaaccgtccggcgccggccaggcagacgacggtgggcacccgcagggtcgtggtggtgcgcagcgcgtccgtgccgagtgccagggtgaaccgcagatcggtgcgcgacgcgccggtcagcagtgcggtcagcaccggggacggctcggtctcgaactccagcaccaggccgagcagccgctgcagcgggccgtggctggcggcgagcgcgaccgcgtcgtggaagtcgtggccggccggcgcgggggcggcccgccgggccagccgcggcggcgggttccggcgcgccgtcagcgtgccgctgtggaactcgccggcctgcaggaaggccatcccgaccacctgatcgtcgtccaggccgccccggtcggcgcggaccgcgccgccaccgcgttggtaccgggtccgcaggtcctcccggagctggttcagccggcgttgcccgaggccgccgtcctggaagccgagcgcccgcagcggcgaccgatcgaagtccgcgaggcagggcagttcccggccggccgagacgccgacctccccccactgccggctcaggaactgcaccacctgccggatcgggtacgacgcgacccgcacgtcgtccagcgcttcggtgacccttggcgtgcgcaccggggtccgcggggtgaacatcgccgtccacacccggctgtccggggccgacagccgccgcccgggtacgactgtcgtggtgccgccgtcgtccaggcgcagggacacgcccagccgggtcgccgcggccggccagtcggtgaagtcggggaactgcccgccgagcgtgacgtcggcgccgtcgccggtcagttgcggcgcgacgtgcacgtcgaagcggagtccgccgtgccggccggcgccccggggcagcagggtgcaggtcaggttctgggttgccatgggagtcctcgtcaggcgaaggcggcgcagtgctgcgcccacaggtcgggggtgaagacgtcgccgaagcggatcggcgccgacgcgatggcgggcgcggtgcggccgaacgacgagctggagcgggtcagttcccgccggcaggtgatcgacacggaggtgctgaacaggaacaggtcgatggagacggtcatcgtcgcctcgccggtcagccggtcgccgtcggagtcgtaggtgaggccgagatagaactcgacggtcacggtgatcaggccgagcaccgacaccgaaccccggatccgcaggtaggcggtcagctcgatgttctgcctgtcgccggtcgcggtgagcttgaagtagataccggccatcacctcgacacagccgctggccacccccaggtcgatgctgacccccgcgccgaactcgaaggcgaactccagggactgcaggccgctcgcgctgatcttgacgccggcgtaaccgccgccgcgcaggatcccgacgccgaggacgaacttgtgctcacgggtggcgaagccggcgtcgaacaccaccgggtcgccgttgaacggcagcagcagcccgacgtgcaccgcgatgttggagatcgcgagcaggccgatcgccaggctgggcacggcgacgtccagggccacggtcacccggtcgccggccggcacgacggacacgccgttgcccctaccgaagccgatcagcgtggccagttcccggacgaacctcagcgggccgccgaaggtcacctcaccgatgtcgcagtgcacatcgggtttcgccccgctgctgtcggtgaaccgcagggtcttgacctgcacggcgatgaacggatcgtcgtcggtgaagaagttcagcgtgacgtcgctgagcgtgccgcgcatgtcgtgggtgggcggatggccgagccgggcggcgatccggatgtcgagcaccagcgagctggccggattcaccttgagaatggcgaagtccgtgagcttcggcgcccagtgcagggtggtctcggcgccgtccggcaggtcccgggtggtgatcttcatggcctgctcggggttggcccggcccgccggcttggccagcacgtcgatcagccgcagatcgcccagcagccgggcgccgtccttcaggatcgccgccgggtccagcttctggttcgcgacgtcgctcagcggaccggcgaccgggccgagcgaccgggacaggccgctgatcgccatctgcggggtggccaccccggtcatcgcgccgggcaccgccagctcggggacgaccttgtcggccatccgcaggaagacctcgccgccgttgtccttgaagccctgctgcaggtagccgctgaaatagttgaacctggcgccgaccgactgcggtgcgccggtgatcgccgccagctgtggcatctccaccgtgaagtcctggaccctggggaacgccaccccggggaggtgcttgccgcccagcgacatggtgtgcacggtcaaccgggtggccgccgggtcgtcggccggcgcgaccgagatcggcaggccgcccaccgcggccgtgcaggcttcggcgttgccctcgtaccacctggtcagcgggtcgagcggatcgtcggccggggcgcgccgggcgttcgggccgagcggcacgaacaccgcgggcgcctggaagtcggtgtcctgcccggcgtggtcggtcccccgccacgggaactgcagcatcttcctgtcggcggtcagcagcatccgcgcgccgccgccgtccggcacgtcctgcaggaccaggtccggggtgacctccagcttcgcggccacccgggtgaacggcatgccgcggccccccgtccggcatgccgggcgccgcggcgtagtcgtgcacccgctgctggatcaccacgaagaagcgtttacgcaggaatccggcctgggcctgcgacccgtccggccggccgagcaccttgcgctcgctgagcgtgatcagcgtggcccggtgcccgaacgggtagaggtagccgtccttggcgatccgcacgtagtggtcgcggcccagcgtcgcccgatgctgccacccggaggtggccgggtcgcccggcacccgggtcggcgcccagtccacgttgctgatcagggtgccgccgaggccgctgagcatcagcgcgtccacctcgatcggcgcccgggccagcgacaggcgcacgatgtcgaaccggtcggccgccgacatggccaggcccggcgggtcggcgggcgagtccggggccacctgcggcggctgccgtgcccagtcggccatctgcggataccgggcccagaccgcgcggacggtccggtcgccggcgccccgctcggtcacgccgcccggcgccgccgggtccttgacccccagccgggtgtgccagagttcggtccagccgcctcgggcggtggccggggtcgtccggtgcacccacgccgcgttgccgtgcggggacaattgcagccggtacgggatctccagcgacgtctcgttgtacagcggcgcccgcgggccttcgtcgatcggcgacaggggcgagtcacgcggccgggccagcggcaccaccttcgcggtgaaccggttccagtccagcagcgcggccagcgtcgccggcagcggcaaccggttcgtcacctcgaacgccagccggctctccagcgccgcccgggtcggcaccgccgtgaccgggaccggctccgtctcgagggaggtctgctcggcgatcgactgggtcgggaaccggaccaccaggtaggacggggctccggggtcccggcggagcagcctcgtcccggacctgtccagctcgacgttgtagaggtcgaacgtcagctgggcgaagtcgatccggcgccgccaggtcagcgtcaggtcggcgagcgggtccgcgggtggcgccagcccgggcgcggccagcgccgccatgtccggcgcgccgaccaccgagccggccaccagcccgcccgccatcccgagcacttcccgccgactgagcaccatggagcgccaccgttcgtcgccatctacgcctgatcgaccgccaggatgatcaactccactggccgccgcagccgattccggccccctaccccgaacgtgtccaggttattctcattccgagaatgactgagctgaagggaacgccgatgcgagtgacgctgaccaggtcggagatcgccaacggggacgagtcgcgcccgaccacgacttggatgccggatgacctggccgtggcccgggcggtggcgctgcgcccggatctgcaccacggctacacctgggtcgcctacgcggacggcggccggccgctcgccgtcacccgcgacggccggtggtggctcgtcggacacccggagagcaccctcggcgagctgggcgtcaccgagatccggtacgacccgtacgaccaggacccggacgaggcggtgcgggtgctgcgggccggtggcagggccggccggcggggcgggcgcctcctcgtccagccgcgcgacacgatgcagtcgcgggtgtgggagctgctgccccggcaggtggccacaccgctcatggtgcgactcggggacgacggcatgcggttgcgcaaggcgctgcggctcacggcgtacctccatgatccgattttggaaaccgacatccggaactggttcgcctgccgtcgggagccgctctggcagctggccgatttctgcagccgcctcctggaggcccacggctacctcgaccggcagcgcgccctggagttccgggtggcgggccgcctgcccgcgccgcgcggcggctggcaggccgacccgccggtcctcggcccggacttcaccgcggtcccgatcaccgacccgaccgcgcggcacgcgctcgaccatctcgcccggtatctctgaccatcgtcaccaccactttgccggtcgccgcgtcgtcctccatgtagcggtgggcggccgcgatgtcgtccaggccgaagacccggtccaggttcggcgcgacggtcccggcccgcaccccgtcgacgaggcgttgcagcaccgcggccccgcgcgggcccgtcatcgtgccgctgtggaaggcggtgagccgggtcccggccggaatcatcgcgatcggttcgaaggagggcaccgcccacccgctgagcgatccgctcacgcagaccgtccccccgggccggaccaggcgcagcgagtcggtcagggtccgcgccccgaccaggtcgagcacctggtcggggccgcccggccagaggtcgcggatccgtccgtcgtccaggatcagacggccgccggtgcgggcgggccggcgggtggtcgccagcacctcgaagccccgggcgaccgccaggccggtggccgccatccccaccgacgaggtgccgccgcggatcagcagccggccgggcggcgggccgagcacgtccagcgagccctgcgcggtcagataggtttcgggcagcgcacccagcacctcccatggcaggtcggtgcggaccggcatcagcaacgcgttgggcagcagcgcgtattcggcgtatccgccgtcgaactcgcgccccatctcccccatcaccgcggccaccgtcgtcccggccggcaccgagggatcggtggattcggcgaccacgccgacgcattcgatgccgagcacccgcgggaacctcacgcccggcgaatgcccctgccgggtccgcagctcggagcggttcagcccggccgccatcacccgcaccaggctccagccgtcccgtaccgccggcaccggaacctctcgcaccaccagcgcctcgggcccgccggcccgctcgcacaccgccgcacgcatcgtcgtcatgccggcaaccctgcgtcccggccaccgtggcgggccaccgctaagctgccacgtcatgcccatcgcccgccaaccggtctcgcgcctgtggccgtccggcggcgcgcacctctggccctccggcgggatcagcgccctgcactcacacccgcgcggccacctggtctatgccgcgcgtggcgttctctccgtgcagtcggagagcggcacgtcgatcgtgccggcgaaccgggtcggctggaccccggccggatccgggcaccggcaccgggcgcacggcagcaccgacatgcggatcgtgttcctgcccgccgccctgtcccggctgctcggcgaccgccccgcggtgttccgggtgtccggcctggcccgggaggcgctgctggcgctgaccggcacccccgagcgggagcgggccgtggcggcccggctccgccgggtgctggtcgacgagctgcgggtggccgacgagcagccactgcggctgccggaaccgcgggacgaccggttgcgggcggtcgcccggctgctctacgacgatcccgcggacacctcgacgctggccgcgctggggcgggcggccggcgcgagttcgcggacaatgagccggctgtgccacgacgagctcggcatgaccttctacgagtggcgcacccagctgcggatcttccacgccctggtgctgctcgccgagggccatgacacggtgcgggtggctgccgcgtgcggctgggccaacccgagcggtttcatcaccgcgttcacccgcctggtcggcaccaccccgggccgctaccgggcgcggggatgacggagaagtgttcaggatcacggtggcggggccgatagccagcgcatgtcccgattccggagcttgcagtttccgcagtccgcgcccgacgcccggatcgtggcgacggtcccggcccgcaccacggtcagctatcccgcggccgccgccgcggacaccggcaccccgccgccgcgcgaagccggagacgacagcagctcagtctgacagcgccgcgaccgaacagagggatcggcaacgcaggaggaggcgcccgtgacgatccgccagtcggtggtgcgcaccgtcgtcttcaccgccctgtacgtggtggcgacctacgcgggccggctgacgatcatggacggcacgaacctgagcctggtctggccggcggccggcatcagtgccctctggttcatctgccagcgctcgtcgcggtggcggtcgctggacgtggccgccctggccgcggccaccgtcgcggtcaacatggccaccggcgcgggaccggccctgtccggcttcttcgtggtcgcgaacctgctgcaggccgccaccttcaccgtcctttaccagcgctggctgcccgggttgtggggcagcggcggcaccgccccggtggcccggccgcaccagctgtggcgcctggtcgcgatcgcgatcatcagcacgttctgcggggcgctggtcggcccgaccggggtgtggctggtcagcggccactattcggcgccggcggccgcggtgtggatggcccgcaactccgccagcatgctgctgatcgggatcgccgggctgcggctgggcgccctcgccgggaggttcaccggcactccgcggcagcgctggccgcagctgtgcgcggcgacccgcacggtgccggggcggacctgggtcgagggcggcgcgttgctgatcgtctccgccggcgcctacctcgccgtcttcgggttcacccacggcctgccgttggcgttcgtgctggtcaccatcacggtgtgggcggccacccggatgagcaccaccttcgtcatcctgcacgacctgttcttcggcagcctggcggtcgtcttcacgctgcacggcaacggccagttcgccgggatcgcctcgcacacctcgcgcgccctggtgtcgcagatgttcgtcgccgtggtggcgatcgtcgggctcgccgtcgcactcggccgcgacgaacgcgtcgccctgcagcgggccgccgccgagcaggcccgcgtcttcgccacgatcttcgacgccatgggcgagggcctggccgtgctggacgcggacggccacttcctgctgcgcaacccggccagctcgcagctgctcggcggtctgcgcagtccgaccggcaggatggccggcaacgacttctacggtctgcggcacctcgacggcaccccggtcgcgccgggcgacctgccccatcagcgagccctggcgaccggcgacccgcacgccatggacatcctggtgagccacccggccgtcccgggcggccggatcctgtcggtgcgggccaccccgctgccggtcgacgtcggcggccgccggtacgcggtcagcgtgttctccgacgtcaccgccgaccggcggcaccgcgacgaactggccgcgttcgccggcatcgtcgcgcacgacctgtccaatccgctgaccaccgtcgaggggtgggccgaggacgtcgccgacctgctcgggccggacgccggccgggccggtgacggcatcgcccgcatccagcgcgccgcgacccggatgcgcaacctgatcaccgacctgctcgcctacaccaccgcccgcgacgccgcgctgggcctgaccggcgtggacctgaccgcgatcggcaccgacatcgccgtggcccgcatcgaccaggccgagaccaccggcgccccggtgccgcacgtgcggatcggcgagctgccgccggtgcacgccgatccggcgctgatccggcagctgttcgacaacctgatcggcaacgccgtcaagtacaccgcccccggggtcgttccggtgatcaccgtgaccggcgaccgggacggcgaccgggtccgcatcgcgatcagcgacaacggcatcggcatcccggccggtcagcacggcgccgtgttcgacaacttccaccgcgcccaccgcgacgccgggtacaccgggaccgggctcggcctggcgatctgcaagcggatcgtggtacggcacggcggcacgatcaccgccgccgacggcccggccggctcgggcagcaccttcaccttcaccctgccggccgccaacctgccgcccggtgtccccgacccggccgcgccggtcccggagcgcagccgactcgcctgatgcccgcgtcagccggccagcctgatcgacggttcctggttccggctcgccgactccttcaaccacactctgaaaacgcctattttgtacgtcgaggtcaccaccctgaccggcgccaccgccccgctgctgatcatcactccggagcgcccagggacgagttgccggcgtttcaggactgggtgaggcctcattctgcagtcgcggcacgttcctgctgaagcaccagatcgcggtagggcaggttcaccaccgcgtggtcgacgagtcccagtcgtcgttccacctgaccgagcagcctcgcggcggcgtcctcgtcgacggccatgacctcggtctcgacgaagcttcccacgccggccaggcgatcgacggtgaccgtcacgctgtcatgttcaggatttcggaacgccgtgcgggtcttctccacccggcacagccggaccatgcccagtgcagtcatcaactcgtcggccgcgatggcctgctccggcccggaaaggagcacgttggtctcccgtttggcgatcacgcccgatgctgagcgcgtgcgaccggtcgacgcgggcttgtaggtgatctcagcgaatccgtcacgttgccggactctgaggcattcaacggtgaccaggaagtcgacgtcaggccggctgtagtaggtgtcgacttcgacgctggtggccgcctcgtggtagccctgcaccctcagccgtcccgtcagggcggcgacgtcggtcagtgcccgtttgcgttcgacctcgatcaggctcatgaggcggtgccgccgtccgtggtgatgaccgtgtagatgcgagccaggctcggtttactgcaccgctcggccagcacaccgagaccgttgcgcagggtgtctgtgtcgttgcgcggcacgttacagaacagcaccagctgtttggcgtctcgtagcgggttggcgagttgcctcgcgaggaaccgattgtagtagtgccggtcgacgcggccgacgtcgccggccacgatgggcatcagcacggtgtcgcggtcagcctcggtcgaatgcacgacgaacgccgtgagtaactggtcggcagtcaggtacgcatacgtctcgcggccttcgcggagcagccacgcctcccaagctgtccggcaggcggcatcaccggtgacggcgttcaggaaagccaggagcgccacttcggtgacggagtcgaagatgtcactgtcgatggtgtggtggtcgaggtagggctcgctcatcgcggccagcatcatcgactgcggctggggaagccagttcacctcgccgcccatacggaagtgcacccgtttgtggccggcgtgcaggtcgacccagtcgtctgcctggtcgccgtcgagcacgggggtgaaaccgagcaggccggaacgccacacgtggtcgcggaaggtgaggtagtggcgttggatctcccggaacagtccgacgggtgcgctgatcaccgcgcaggtccgtgggtcgaggtcgcccagcggcaccatccgcgagttctggcgagccaccacctcgtcgtcggcgcggtggtacgggtgggtgctctcagccaggtaccggggtgtgaacagccgcaggaaggtcagccaggtcggagagtggtaggtctgggtcgcgcgttcatacaggctgggcgcgtcgacggcgtacacgtcgcggtaggcgaagaacccgccgggggtcagaacttgcggcagggtacggatcatggcgtgcagcccggcgtagccggtgccgtaggagtacacctcgtgcagcagcgcggaggctgagatgacgtcgaccggttccggtagcagcgtgttgaggtcttgcgcgagcccatgccgtaattcgcagtgcccgatccgtttgaagtcgtcgatcgcgtccgtcaaggattgcgaacgtacgccaggcgcctcgatcaaggtcagggacacctgccgatcgggcttcgcggtctgggcgagcttgctggccagataggcgactgcggcgccgccgcccggaccgagctcgacggctcggggcgctcggcgctgtacgcgctgcagagcgcggtgcatcagcttgcctttctccgcgccgtgagtgttggcggcgacgtccagatacgcggtgctcgtcttggcatcgcgggcgaagttgggcctgtcggccagtccggcggttgttaccggcatcgaatcttctccttgtcggcggaaaggttcggctctccccgtgatgtgggaggttcgatcgcctcgtctcgtccgtccggaggcttgatcacggacagcgacaagacacggtgatgtcctgattgacgcccagccatgtcggcgggggaagggttttgtctatcggcggcaattggtttgcagtcgtcgacaacctggtgccggcgcagcacactgtcggtaactgcggctggggcgggtggaaccggcatggaaatgagcagcgcgttctggagctcggcgcggatacaggccgcggtggccgcggatgacgtcggtacggtgatccgactggcacgtcgccgggcggatctgaaccagacccaactcggagcactgtgtggctactcggtgtccacgatctcccgaatcgagcgagggcagccgccgagccaggacgttaacgtccggcgccgagtcgctggagtcctgcgtattccactggagctactcggtcttgcccggccggctggcgggacagccatggcgttcacccgcgtggagagcagtgcaatcggcccaggcggggttagtgtcggtgcgaccatagctggaaggggcgatccggtgcgacgacgtgatgtcttgtcgggcttgaccgcgagcgctgccgcggccgcgctgcctcaccctgaccggcgggccacgcctgtagccaacctcgcggacctgctcagcgcggaaacgatgagcacggcgccgatgaagcgggagatcctcacccagcggttggcatcggcacgtcgattgttcagcaccagccgatacgacgaactgaccggcgatctggtcgccctgatcgcgggcgccgctgcaacgcgccgcgacggcgcgtccgctgttcgagaggccgccacggtcatcctggccgcgggataccggctcgcttccgagctggcggtgaagcgcaacgacgacgctctgggttgggtcctggcggaccgggcgctgaccgccgcacgtgccagcgggctgccggcgccggtggcgcacgcaagccgatccgtcgctgtcgcgatgcggcgcgccggacaccacgatgacgcgatcgctctgctgatgaccagcgcccagcagctccgactcggtccgcagccccgggacttggagctggccacgtacggctcgctgctgtgtacggccgcctacgccagcgcccaggcaggtcggcgcggtgaagccgaaaccctgctcagcgaggcgagtgccgcagcggcacgcctgggcgccgcggtctacgccggtgaactcgttttcagcgtcaccaacgtggccgtctaccagatcggcgtcttcaccgccctgggtgacagcgctacggctctgcaccatgcgagcaccgttgaggtcgcgacgttggaaacagcggagcggtacgcacgctattgcatggatacggcccgcgcgtgggaacagcagggacgtcacgaccgcgccacgcaagcgctgtgcgccgccgagacccgtgccccgcaggaactgcggcgtccctcatcgcacgaattgatcacgcggttgttgtatgcaccggtggtaatgccgagtggcctgcgcagcctcgccgcgagggtaggagcgatccgctgaccctggggcagcttcgaccgtgcaagacccgacggccgggctgatgatcggcaaggcggagttcgatcggcaggccggtctggtcaggcaggcctggcgtcgccggcgggtcggtgtttcctgaggcgggttttccgggcggcgccgtcccgttagatccgtggttctgcccattcgcggggacgcgtttctccctaccgtcgaggatgttcccgacacctggagaagcgatgaaaccctatctgtccgcgacgaagcgcgggctcgccgccgcgacggccaccgtgatcgccggcacgctggcgctggcgtcgaccgccgcgccggcgctcgcctcacccggcccgaccggggtgcagtacgcatatctgaacatgtacccggccgtcccgcccaccagcaccaatccgctggtcagcgtcaggcagacggtcacctgcccggccggcaccaagctggtcggcagcggtggcggtggcggcccctacctcggtgcgatatcgccgtccgacgacgcggccaccgtcgacggccaggtggtgttcgataacggtgaccatgtcgtcggcgagctcgtgtgcagccccgccgcccagttcgccaacgtgaccacgctgatggtcaccgacaaccgggtccggccgaacaccatcagacagacgttcgcgaaatgcccggtcgaccggtacgcgatcggcggtggcggcggcttcaacggcgcgacctatctgggtggcacctcgatcttcagcaacgggccgacgccggacggcaggagctgggaactggtcggcatgccgccggccggcgccagcaagctgcggatgttcgtcaagtgcgccccgaagaccgggcaggatctgctgatcaccgcgaccagcctggtcgcgcagacctccagcttgcagccgctgtccgggcgcgcgtactgcccggcgggctatctggccgtggccggcggctaccacgtggccaacccggacggttcctcgttcctcggcggcgtccagccgccgatcatgacctggtcggtgccggttccaccgacgacggtcggcaacgactcgaactggtacgcgtcgggcgacctgccgaccaagacgagactgatcatcagcgcccaatgcgtcaaatagccggggcgcttcccgcatgacgctggaacccgccggcgccgggacccaggtacccggtgccggcggaccgcacgaccgagaagatccgcaccggggggcgcccgatgcgtacgcgaataatcatgttggtcttgttggtggtcgccggagcgggactgttccgggccgggcgggtgaccgcgccgacgttgaccctggaacgcccagccggaaacgccgatcggccgccggcaccgggttcttccgtgcccggacggccgcaccgtcgcgacgggggccgtccgggactgctgatcagcgcagcgtcagggcgcggcaggccggcaggatcgcgtcggcgagggctcggtggccgtcgtcgttggggtgggtgtggtcgtcgcagagcagtttctcgtcgccgtcgacggtgcgccggaaggcgtcgacgtaggtcagcccgaggcgctccgcggtgccggcgacccagttgttgatcagggtggcgcgctcggagagttcggcgaccggatagtaggtgacgacgaggatcggccggccgggaagttcgtcgcgcaggcgggtcaggtcgcggtcgatggcggcgcggacctcgtcggcgtgctcggggagcatgcggatgtcgttggcggccaggcacacgatgacggcgtccgggtcgagacggatggcggcgtcgagcagtgtcgtgtcggtggccgacggcaggtagcggtcgtcgccgccgcgcgggccgcggcggcggaagtagcccatgccgttgatcgacaggttcacctcgcgccagccgagctcgtcgctgaccaggctggaccagcgggcgcgcgggtgtgtcgtgccgcgccagccggtgacgatcgagtcgccgtagaagaccacagtgggatggttcgaagcatgctgcgaggtgaccacgcgtgaggttatccggtggtgcgggcggcggtcagggcgggcagccggccgaaagcgcggacctggacgacgacgcctgccgccgctcacgatcgcggcatgggatgctgtggcatcggcatcccggcgggacgatcatgaacctgagcatcatcggacaggccgcgggcctgttcgcggtcaccaacatcgacgacatcctgatcctggccctgttctccgcccagggcgccggccaccggcacaccacccgcaacatcctcgccggccagtacctcggcttcgccggcatcctcgccgtcgccgtggcggccgcggtcggcgccacactcctgcccgagcgggccgtgccctatctcggtctggtcccgctggcgctgggcatcagagccgccgtccaagcctggcggcaccgcaacgacaacggcgacgaccggaccgaagcgaccggcgacgctcccggcatcgccgccctcgccgccgtcacgttcgccaacggcggtgacaacatcggcgtctacgtgccggtcttcgccaccgcgggagtcggcgcgatgaccgtctacgtggtcgtcttcctgctcctggtcgccgtgtaggtcgccgccgggcggttcttcgccgcccgcccgatcgtcgccgaggcgctcagcaactggggacacgtcctgctgcccatcgtcctggtcggcatcggcctgctcatcctcatcgagggcggcgcattcggtcggtgaccccggactgcgcggcgggggtctgcgaggagtgatcaccccgttctccgggggcgccggtgtcgaagttcgaggttgtctgcacgaatgaccgagtttctctgcacctcggcagccagcttctgttcgagcgggtaccgcttgatgccgaagtgtcacacccagcggcgatgatcttcacatggatacctacgccgacctactacaacgacttgcggaacgcgctcacaacgaacaccgtgaccttcgcgcaccgggttcggcccggactgtcaacttctgccgttggtcggtacacccggggaggcatccgccgtgtcccgttacctaaccgctagaacggaaggtgaaggaactgactgggcatggccgcagggagttcttccgatcctcgactggggttgcgcgatgtacgcctgcgtcgactgccgcagcgtcgacggcacggttctcctgttcgaaccgaacccaggcgatctagacgaggcctggtacgtagactcatcgtccttggcggtgatcgcgtcctgaagcgcggccatgtcagccggacacctcaatggatatcgcgttcgatccgtcctggcgtacggatccaagatcgatgacgatggtccggtgcaaatgtccgtcatgatcgcccaagtccccgccgtctggaacgtcgacaccaacctgagcaccgtgcgagatgttctcgacgaggcgcatcgcggcgatgtcgtcgttctgccagaggggatgttgtcgggctacgacgaagacctgactccgctggacgcactggatcccacagcggtccatcacgccgtcgcgcaggtggcgcggctggcagtggacaagcaggtgcacgtcttctgcggatcgctgctgccgcaacctgacggatggtgcaacgccggtctgttcttcccagcggacggcggtcgtcatcagatctaccggaagatcaacctggcaatgaacgaacgcggccggcttcacccgggcgatcagctgccgaacgtcgacattccgctgcctggcgggcccgtcaccgtgggaatgcagctgtgccgcgagatccgtttcccggagcagtggcagtaccttgcgaccactggcgcccggttgttcgtctacctcaccaacgccgccaacacccgcgagcctgaaggcgtctggcggagccacctgatcagccgcgctgccgagaaccagcgcttcctggtatccgccaacatcgcccaccccgaccggcactgccccagcatgatcgtgtctccgcgcggcgaggtcatcggtgaactgcccgccgggcagcacggagttctccggcaggtgatcggcctggacgaagcggggagctggtatctcggacagcgacgacaggatgtcctgtcactcgactaccacggaagcccgctccggccggaacagcgctcatagcccgggagcagagccgaccccggtgcgcagaggagtgcggtcagctgtgcagacggccgcggaaccgcacagcccgctatcctccggtgcgttcgtcgtacctcttgcgggcgtcgacaacctcctcgatgtgctgcgtcgaccactcggtgagtgccttcaggggaccgcgcagggtctggccgagcggcgtcagctcgtactccacccggatcggcgcttccggatacaccgtccgcaggatcagcccgtcgcgttcgagcgtgcgcagcgtctgggtgagcatcttctcgctgatccccccgagctgctgccgcagctgcgtgaaccggcgcgccccctgcctgccgagctcgcccatcaccaggacggcccatttgctgccgatctggtcgagcaggtcacgcgacgggcagccccgcgtatacgggtcccacgatgatgtggactcgcccacttcccggatcgtcgccaccaatctcacctggatcctttcacccgggtaggcaccttacccgaaagttcgcccttaccaaaggagagcgaccaggtcatcgtggtttcacgtcgcggagggcccgcggcaggaaggtgccaccgccatgtcgatcgttgtcactgcagcctccggacgtctgggccggctcaccgtcgaagcgctgctgacccgtggggtgccggcctccgagatcgtcgcgaccagccgtgacatcagcaggatcaaggacttcgccgaccgcggtgtcgaggtccgccgggccgacttcgcggagtccggcagcctccccgccgccttcgcgggggtggacaagcttctgctgatctccaccacgaccccgagcgagcgcgtcgcccaccaccgccgcgccatcgacgccgcggtggtggcgggcgcgtcgctggtcgcgttcacgagcatgctgcacgcggacacgtccaccgccagtctttcgaccacccaccgggccaccgaggagtacctgcgcgagcgcctccccagcgtgatgctgcgcaacggctggtacctggagaactacaccgaccagctccctcaggtactgcagggcggagcgctcgtcggggccgtcggccggggcaggatcagcgcggcgacccgagccgactacgccgacgccgccgcggtcgtgctgaccaccgacggccacgacggcagggcgtacgagttgggcggcgatgaggccgtcaccctcacgcagctggccgcggcgatctcggccgcgacgggcaggcggatcggctacaccgatctgccggtcgacgcgttcgcccgggtgctggtcggcgcgggcgtgcccaccgagctggcgcaggtccttgcggacgccgaccgcgccatgagccacgacgagatgttcaccgactccggcgacctgcggcgcctgatcggacggccgacgacgactccggcggaggcgatcgccgccgcactccgcggaccgggcggcgctgcgctgcctcctcccgtgattgatcccggccggatgacgggcgatctgccgcacgcccgcaccggtcgcagcatgctgcgaccggtcttgtcccggcccggccggcgagcgccgggccgatcacttcccgcgcccggaaccccggagatcacgaccggggtcacggggccggtcagcgggcggaccacacctggttggcgccccggttgcagtcccacagttggacgatcgtgccgttcgcggtgccgttggcgttgaggtcgacgcagcggccggagggcacgccgacgatggtgccgtcggggtggaaggtgaagtgctggttggcgccgccgtggcagggccagatgatcagcctggtgccgttcgcggtgccggcgccggtcgcgtccaggcagtcggcgccgttgcggagttcgccggcggcggtgcggacccactgctggttggccgcgccgtggcagtcccagagggagaccgtggtgccgacgtccaggcagcgtctcgactgcgggttggacagcagcacggtcgccccgaccggcggggtggtgagggtggtcaggctgccgggcaccgattgcagggcggcgtaccagcgggcggccatcctgtcgtagccggcggcgttcgggtgcacgccgtcggccaggtcggcggtggtgagtgcggagtgctggtcgaccaggtgggtgagcgggcccttctgggcgacgatgccgggcagggccgcgttgaaggtctgggtcttctgctcgttcgccgcgttggcggtcgggatgatctgcgcgacgaacagctgcacctgcggcgcgttgacgcggatcttgtcgatcagggcggagagccgggccggggcgttggcgacgtcgtagttctggccgatgtcgttcgtgccgatgtgcagcaggatggtacgcgggtcggcctgctggatccagccgacgatggcggcgtcgagctggtcgatgcgccagccggggtggccctcgtggtcgtggtcgccgaggccggccgggccgttggagccggagccgacgaggtcggtgaggtggccgtcggcggccaggcgctgccacagtccgatgcggtagccgccgggcacgttgtagccgtcggtgatggagtcgcccagtggcatcacccggacgccgccgttggattccgccgcctgcgccggggcggcgagcgccaggccgagaatgccgatcgacagcagggccgcgagacgtttcatgaccggctccacttctggttgtcgccgccgttgcaggtccagatttcgagcagggtgccgttggccgtgccgtggccggtggcgtccaggcatttgccggagccgattccgacgatcgtgccgtcggcgttgagcgtccactgctggttggttccgccgtggcaatcccagatctgcaccttggcgccgtccgcggttcctccggcgttgacgtccaggcacttcgacccgtacaccagcaattgtttctgatctgtcagggtgaagttctgattgctgccgccgttgcagtcccagagggcgagctgggtgccgttggtctggctggcgccgggcacgtcggcacagcggccggattcgacgccacgcagcgtgttgagggccgggccgctgttgggggtgacgctgaggttgtcgaactggtcggtctggtagccgacgacgccgacgccggcctgccccgcgccgtacgcatagtcggtgacggtgcccaccgtggtgttgtcgatggcggcggtgatctggccgccggagaatccgagtcgtagattgtgccagctgttcaggcccagcgcggcgcgggtgccggagacgagcgtcgtgtccgtgtcggcattggtgtgtttgacgatcgaccagccgccgttgtcggtgacgcgcagctgataggcggcctgccggttctgcggacggttctggatgttggcccggcccagcagcgtgacggtgccggcctgctgcatgttcacgtcgaggctgaccgtgtaattggtccagccggtgtcgccgaaaagggtgaaggcgtcgctgtcgtcctgccaattgatcggccgcagcggcgcgacctgctgcaggcacgtcccgccgcgcccggccgagcaggcccgggtttcgaacgacccctgcatgtcctcgctgtagtggggcagcttacggaccgcatatccgtcgaaattgtcgctgtacggcagggccagaccatgcggagccggacccgccgcggtgcctttcccctgcccggtggtcgtggtgacggtatagatccgattcggctgcagattgagggtgtacgtcgcgccgaccggcgtgatgtcggcctgccggacgaaccagtcggcggaattcgacgagcccatgtcggtcgaccacacgtgaacggtgccggtgctgagcccaccggagacggtgacgttcacggtttgcgccgcggtgctgccactggtctcgtagatggtgctgtagtcggtgttgttcgtcgatttgagcgtcacatagctgccgttggcccggttcccgcccaggtatccgctggccgaactgttgagatagtgccagccgggctgggtgaactgggcgtaatgcgcgttcgcccacagattccggcccacccgataggcccccgaccacggtgagccggcatccatcaggcccaccgtggcgaacggcagattgggggtgatggccgcgatcagcggccagttcatgtatccgctgatctccgcgtcgaggtaaccccggttgacggtacggatgtacggcaccacgcccgcgttgtcgtcctgggagccgaattcgctggcccacagtggtttcccgctggagcgcgcgttgcccgtggtgctgcacgagtcggcctgggacagatagccgcagacgtagtggttgccgagcacgccgaccgcgtttttcaacgtggggtcggcggcgaactcgtcggccatcccccagccgctgtcgtcgccgacgatctgcaccgcggagtatccggcgttgtcgagcccggtccgcaggttcttgtaccaggtgctgtcgtggccgcgttcgttccagccgcccaggtagctgatcgtcaggccgtactgtctggcgcagttgagccaggagacgtcgtaattgatcatgtccgtggaccagaaggaaccgccgccgatccagccgggcgcggcccacggcagggcgaccagccggatcccggggttgcgggcgaccgcctgctcgccgagccagaattcgtagccggcgttgcagttgatgtcgccgcgtacgtgctggtggctgggctcggagccgtcggtggagttggcgtcgccgccgatctccagtttgagcagctggaccgcggcgccgtagcccggcttgaacaggtagtcgaggatctgcccgcgctgcggttccgggtagtcgatgagcagccgggagttgccgccgccaccgctgatcgcgccgacgccgtcgaaggcgcggccgacgatgccgccgttgagggcgacggtggtggccgcggcggccggggcgggtgcggcgagggtgccgatggcggccgcggtgaccgcgaccatgagcaagtgacgcatgtgccactcccctgcgtgtgattacgcgcgacaatgtcggatcttgggtcaacgcatccgtcagcgtcgatgtccctgtaaggcatgaactatccctggccatccccgcaaccagcgagccacgatctttccgcaatcaggcagtaacaatcggatgtcttgacatcgaccgtccgacagagttcgatgacggccagtcacgttggactgtgtgcgtttccgctagctcggagggcgacccatgacacgtttcgactccgccggcctgacccggcggtccctgataggactcaccggcgccgccgcgaccgccaccctgctcgccgcctgcggcagtgacgacaagagcgggacgaccagcgtcagcgacggcaacgggccgatcacgttcggctccaactactccgacgaggcgcccaaggcggccttcgcgtcgctgatgcagcaggcgaccaccagcaccaccgtcccggtcacggtcaacaccacggaccacaacacgttccagaacaacatcagcaattacctgcagggcaccccggactcgctggccacctggttcgccgggtaccgcctgcagttcttcgccgcgcaggggctgctcaccccgatcgacgacgtctgggacaagatcggcggcaccttcaacgacgccgcgaaaagcctctccaaaggactcgacggccactactacctggtgccgctctacaactacccgtgggtcgtcttctacaacaagagcgttttccagtccaaggggtacgaggtcccggccagctgggaggcgttcatcgcgctggcccggaagatgcagtcggacggactggtcccgctggccttcgccgacaaggacggctggccggcgctgggcaccttcgacatcctcaacctgcggatcaacggctacgactaccacatcaagctgatgaagcacgaggtgccgtggaccgaccccggggtcaccaaggtcttcgaccagtggcgggaactggccgcgtaccagcagaagggcgccaacggccggacctggcaggacgccgccaaagctctggagaacaagcaggccgggatgatgttccagggctccaaccaggtggccgccaactacagcgcgaagaaccttcccgacctggacttcttcgtcttcccggcgatcaacccgcagtacggcaccgactacatggacgcacccaccgacggcttcatcctgccgaagaaggggaagaacgccgccgcggccaagaaggtcctgcaatacatcggcaccgccgaggccgaggccgcgttcctcaagaccgaccactgggacgtcggcctggccaacgggctgatcgcacccacctacaacgacatccagaagaagtcggtcgccgagatcggcaaatgcaagagcgtctcgcagttcatggaccgcgacaccgtgcccgacatggccaacgcgatgatcaagctgatccagcagttcatcgaccagccgaccccggagacgatcgcgaccgttcagaagagcgctgaggaccaggcgaagacgattttccgctgatgaccccgaccattcgaccggcgccggccgcccgccggcgccgccgcacgctcacccgccgcgacgtcgcggtcgccgccgccatgctcggcgtgccgctactgctcgacctcgccttcatctggttcccggcgctcgcctccgtgctgctgtccttcaccaaatggaccgggatcggctcgatccggatgcggtcctgcgcggatttcccgtccgcgcccggcatcccgcaaccgggttgcctgaacggcgtcgacaattatcgccaggcgttcaccaattatccggacttctggccggcggtccggcacaacgccatctggctcgtggtcttcatcctcctcgcgacgccgctgggcatgctgttcgcggtggtgatcgaccgcggggtgcggggcagccggttctaccagagcgtgctgttcctgccggtgatgctgtcgctcgcgctgatcggcatcatctgggagctcatctactcccccaacttcgggctgatcaacacggtgctcgggcacaaccacaacgacaacctgatcgactggctcggcaatccccggctcaacctctgggcgctgctcgtcgaggcgagctggcggcaggccccgtacgtgatggtgctgtatctggcgggtttgaaagcggtcgatccggcgctgcgcgaggcggcgatcgtggacggcgcgaacgcgtggcagacattctggcgggtcgtcttcccggcgatgcgaccgatcaacatcgtggtgctggtcgtgacggtcatcgagtcgttgcgggccttcgacctggtctacatcaccagcaacggcaatccgctgcgcggcctcgaactgctgtccgtggcggtcacccagaacatcgtcggggaaacccagcggatcggcttcggctccacgctgggcgtggtgctgctggtcatctcgctggtgccgatctcccttttcctgtggcaggcattccggcgggaggaacggtgaaacgtaccggatcgcagctcttcctgctggtcatggcggtgttgtggctgatgccgatcgttttcgcgctgtacgtcgcgttacgaccgatcgaagagaccaatcagtcagggtacgtgtcactgccgcaccagatgaccctgtccaacttcgcgcatgcgtggacccgatccggcatgtggcgattctttctcaattccgtctatgtcaccgtgccggccgtgctgatcaccctgttgctggcctccatggcggcgtacgtgttgtcccgcctcggtttccggttcaacattccgctgctgatcctgttcaccgccggcaacctgctcccccagcaggtcatcatcaccccgctgtaccgcatctacctggccgtccacctgccgtcctggctgagtggaagcggcctgctgtacaactcgtacgccggcctgattttgatcaacgtctcgttccagctgggcttctgcgtcttcgtcctgtcgaattacatgaagaccctgccccccgccatcgacgaggcggccctgatcgacggcgccacgctgtggtcgcgttactggcgcctgacgatgcccctgtgccgcccggccctggccgccctggccaccctgctcaccacgtggatctacaacgacttcttctgggccatcaccctgatctccacgggtgaccgccgcccgatcacctccgccctggccaacctgcagggccagttcgtctcgaaccagaacctgatcgccgccgcggccctgatcgccgccatccccaccctggtggtctacctgctcctgcagaagcagttcatcgccggcctctccctcggctccaccaaggggtgatctggtaaccgtcggcgctggtggagaagccgggcgaggcgtccggggacgccctgaaggtgagatactcgccgacggcggaccgtcggcgctgggccagaccagccgttcagcccccggtgtgcgcagccctcgatctgcgcacgccggggccggcgcccaccgtcccggccgttccaccgcccggcccggtgcggcgggcccggtcacggccgggccctccgcacggtggcgtcagcgctgccaggtgagcgtggtcgtgccggtgccgccggccgggacggtgtaccggtggttggcaccaccctcccaggtcaccgtgccgtcggccgcgaccttgacgaacttgaactcgaccggcgccccggccggcaggtcggcgacgaggacgccccgggactcgttcggcacccgcagcagctgtcccgcggtctggtccgggctggtcgaccagtgccccaactcggcgacgtcaccggtcaggtagagcgactccccgggcgcggtggccggcgggttctgaacggtgaactgcaccgggaccggttttccggtacgggtggtgatcgggtacccgttgctggtgccggagccgttgccgacggtcacctggacggccccggtgggaacgccgaccgggacggtggcggtgatacggtccgccgtccactgctggacggtcgcggggactccgccgatcgcgacggttccgccggagccgaagccggtgccctcgacggtgacggtggcgccggcccgggtcacgaccggcccgaccccgccgatccggggctcggtgtccaccggcgcccggtacgaccagacggcgacctgcccggcacccagcaccggcgcgacggtcgaccggtcggtgccgtcgccgtcctcgacggtcaggtcggagccgccgaaggtgccgccgagcacgtcgcgataggtgccggccggcagcgcggtgcgcagcccgtcgagccggtactcgtgcgagcccttgttgatggcggtcagcagcacgttgtcgccgaaccggcgctcgtagacgtacacgtcgtcgttgatccaccgctgctggtggtccccgtaggccaccgcggggttcgaccggcgcaggtcggagagggcgcggatctcccggtaggcgaccgtgtcggtgtcgaaactggccatcgggggccggttgtacgggtccttgcccttgttgctgccctcaccggtgtcgttgtgcaggtactgctcggtgccgtagaacaggcacggcgtaccccgggtggtgagcaggaaggcgagcgcccggtgcagggccgccggatcgctgttgagcgtcccgaagcgccgggtgtcctggttgtccaggaacgtgatcagatcctgctcgtagaggtagtcccggttggtcttggtgatcgccgcgtccagggacttcatcgagccggcgccggcgaaggtgtcgcggatcgagcggttggtgtagaagtccatggccgcgatgccgctggtgttggcgaacttgacctggtcggcgtagagcggatcggactggtcgcccatgtaccactcgccgaagatggccgcgctcttgtgcgaggtgaccgcgtcggcgaaggaccgctgccagctcagcggcatgtgcttgacggcgtcgacccggatgccgtcgaccccgcggtccatccagtagttggcgtcgtccttgagcagctggtcgacccgcgggttctgctggtcgaggtcggcgatgtcggccaggctgtagtactggtcctggtagcgatcgttgaagtcgccgatcgccgggccgtggtggaagtgcccggcactgtccgccccgtacctgccgaccagctgcccatcgtcgtagagggcgccgtcctcggcctggttcggcgggttggtgccgttcggcgtccagtccatgatcactttgatgttgctggcgtgcgccgccgacaccagcgcgtcgaactcctcgtcggtgccgaagtgctcttcgagccgcttgaagtcgcgcggccagtagccgtggtaaccggtggcgccgttcgccggaacgttgatgttgtcgacgtgcggcgagatccagatcgcgccgacgcccaggttcttgaggtactccatccgctgggtgatgccggcgaagtcacctcccatgtatttgagccactcctgccggtcgttcagcttggtcttgtcggcgaacatgccgggcacgttgcccggattgttgttcgccgggttcccgtcgctgaaccggtcggtggcgatctggtagcagaggtcctgcttgagactggccgggttaccggcgtacggcaccacggccgaagccccggcggcatgagccggcagtgacggcggcagcagcgaaacggctaccgccgcggcgatggcatgcctggcgtgacgttgcacgagcttctccttgtgaagggatgacgaggaagggcagggcccggagaccgctgcaagaacttgcagaagacgtcattcagatgcgcatacagtgatggatgcatcaccgccacttcaaccctaagcttgcgcagagctttaagtacatcgacctcagaccatgcgcaattgccgttgagctgcagttttaactacctgatcgcgatctatgatctgggctacagcgtgccgtcccggttctgaaacttcttgctaaaacagcaagttcttgcgggcacgtctcccgccgggctagcgtcccagcgatcgcgagagagggtccacgatggatgaaagactgaaatctcatatcgtccgggcgctgctgcccgtgctggtgggggccgccggtggcctgccggctccgcgggccgcgcaggccgaatcgccgccggaccggccgtcccacgccgagcagctctacctggtgatgcccgaccggttcgccaacggcgacaccggcaacgatcagggcgggctgaccggagaccggctcaccaccgggtacgaccccaccgacgccggcttctaccacggcggcgacatccagggcgtgatcgacaaactggactacatccaggggctcggtaccacggcgatctggctgacgccgatcttcaagaacaagccggtgcagggtacgggtccgaacgcgtccgccggctaccacggctactggatcaccgacttcacccaggtcgacccgcacttcgggaccaacgaggacctcaagcggctggtcggcctcgcccaccggcgcggcatgaagatctacctcgacatcgtggtgaaccacaccgccgacgtgatcaagaacgccgagggcaccgcctacgccgacaagggaaccgcgccctaccgcgacaccgcgggtcgtcccttcgaggaccgcaactacgccgacgggacacacggcttccccaaggtcgacgagaagtcgttcccccaccggccgttcttcgagaagccgtccgacgccaccgccaaggcacccgcctggctcaacgacccgaccatgtaccacaaccggggcgagaccaccttcggcggggagaacgccgaatacggcgacttcaccggcggcctcgacgatctgtggaccgagcggcccgaggtgctgcacgggctgaccgacatctacgccggctggatccggcggttcggcgtcgacggctaccggctggacaccctcaaagccaccgacctggcgttctggcggcctttcgccgagggcgtgggcaaggccgcggacaaggcgggcaagcgtgacttcttcctcttcggtgaggcctggagcaaggaccaggaagtcacctcgacgttcgtccgccggggcggcctgcccgcgaccctcgacttcccgttccagggcgcggcccagagctacgtcaccggcaaggcaccggccagcagcctggccggcctgtacgcgaaggacgacctctacaccgccgccgggaccgacgccggccggctgcccaccttcctcggcaaccacgacatgggccggatcgccactctgatcaaggccggctccgatccgaacgggctgcgccggctcgaactggcgaacgagctgatgttcctcacccgcggccagccggtggtctactccggcgacgagcagggcttcaccggcgccctcggcgacaagggctcgcgccaggacatgttcgccagccggacaccggactacctggacgaccgcctgatcggcaccgacaagacccacgcgagcgacaaccacgacaccgggcacccgctctaccgcaccatcgccgagctgggcgcgctgcgcaaggcccacccggcactgcgtgacggtgagcagatcacccggtacgccgccgaccgcgccggggtcttcgccgcctcccgcatcgaccgcgaccagcgtgccgagtatgtgatcgcggtgaacaacgcgaccaccgcgcagaccgtcaccttcgacacctacaccccgggctccggcttccagcctctctacggcaccggcgagacggcggccaccggtgccgacggccggctcaccatcaccgtgccggcgctgtcggcggtggcctatcgggccgagaaaccgatccccgcggcggacggcgcccccgccgtgacgatcaccgcacccgcggccgggaccctcgtgccgggccgcaccgaactgaccgccgccgtcaccggcgacccgctgtccaccgtcaccttctccgcccgcgccggtaacgggccgtggcagccgatcggcacggccggacgggccccgtaccgggtgttccacgacctgaccggactggccggcggcgccgaggtgcagtaccgggcggtcgcccgggacggccgaggccgtaccgccaccaccaccagccggatccgggtcggcaccgtgcgggccgaggcgggctacgccgtcgtgcactatcagcgtcccgccggcgactacgacggctggcgcctgcacgccaccggcgacgtcgacgcggccgcgctcgacccgcagggagagccgttcaccgggacggacgcctacgggcgcttcgcctgggtcaaactgcggcccggcgccacgaaggtcaccttcaccgtgagtgacgccaacggtgtcaaggacgtcgacgccgaccgctcgctcaatccccagcagacacccgggatctggctgcaccagggcgacccggccatctcctaccagggtccggcgcccgcacccgcgccgaacaccgcgatcctgcactaccggcgtccagccggcgattacaccggctggggcctgcacctgtgggacggtgcggccacccccaccgccgactggggcgcgccgctgctgccggagtcgttcgacagcttcggtgcggtcttccggatcccgctggcggccggggccaccggtctcagctacatcatgcacgccggcgaggccaaggatctgccgaccgaccagcggctggagttcgccgacgcgggccgggaggtctgggtgcaggcgggcgtccaggaacggctgctgccgtcggtggtgaaaccggcgaaactcgatctgaccagggccgacgcggtgcgggtggaccgggacacgatcgcctggcagaccggtacgcccgacacgctggaaccggccggggcagccaccgacgggcgcgtctacgacctcgtgcacgccccgaacggtgggctgcgcctggtcgacggtgacctcgccggcgactatcgcagcatccggctgaccgcgcagcgcgacggcctcaccgagaagcagcggcggcaggcaccggaactgtggcagtacccggcgttccaggcggcggccgccctgccctccggtgacggacagttctatgtgactgagcgggatgcgcaaggccggctcatgtcggtgaccggagtccgctgaccggcgctgcggcgaccacggaccgggccggttcctcgcctcgcggggggccggcccttcgccgcccgggccggtcaccctccgcgggccgctcacccggcggcggcggtcaaggccggccactgcggggtacggctgagcccgtcgccggtcagagccagcaggtactgtccgtagccgctgctcatcaacggctcggcgagggcacgcagctgcgcggtgtcgaggaaaccggcccgccaggccgcctcctccacacagccgatcttgatgccctggccctcgtcgatggcgcgcacgtagtcgaccgcgcgcatgcagtcggccagggtgccggtgtcgagccagaccgcgccccgacccagcagcgtcaccgagagtgcgccgcgccgcaggtaggcctggttgacctcggtgatctccagctccccgcgggcgctgggccgcagcgaccgggccgtctcgaccacatcggcgtcgtagaggtagaagccgggaaccgcgtacggcgagcggggacggaccggtttctcctcgatggacagcacccgcccggcggcgtcgaactcgaccaccccgtaggccgacgggtcggccaccgccactccgaagacgtgcccaccggccgtctcgcgtgcccgctgcacgcaggggcggaagtccaccccgtgcagcaggttgtcgccgagcatgagcgccaccggcccaccggccaggaactcctcgccgatgaggaaggcctcggcgatgcccccggggcgctgctgcacggcgaactccagacgcaggccccactgcgagccgtcacccagcaaccgctggaactgggcggcctcggtctcggtcgtgatgaccaggatctcccggatcccgcagctgacgagcgtggccagcggatagtagatcatcggtttgtcatagaccggcatcagttgtttggaaaccgcccaggtcaccggtcgaagccgtgagccggttcccccggccagcaatattccgcgcacgtgaccgaccatatcagcaagccccgtaaatggctcggccgaacatcgggcacccattggcggcattgctacaatcccggcgatgaaaatcttggtcaccggcggagccggctttatcgggtcccattttgtaacttccctgatcagtggcgacattgccacaccacaacccgtgacgcaggttacggtcgtcgacaaactgggttacggaggcaatctcagaaatctcgccgaagcgtcggcggaccctcgtttcagcttcgttcggggcgacatctgtgacgaaggtctaatcgaggggctgatggcgcggcacgacaccgtggcgcacttcgccgccgagacccacgtcgaccgctcggtggtcgcctccggccccttcgtggccagcaacctggtcggcactcaggtgctactggacgccgcgctacgccaccatatcggccgcttcctgcatgtttccaccgacgaggtgtacgggtcgatcgacaccggctcgtgggccgagggccatccgctggcgcccaactcgccgtacgccgcgagcaaagccgggtccgacctcctcgctctggcctaccaccagacgcacgggatggacgtcgtggtgacccgctgctcgaacaactacgggccccggcaattcccggagaaaatgattccgctgttcgtcaccaggctgctcgacgggctcgacgtaccggtctacggcgacggccgcaacatccgcgactggctccacgtcagcgaccattgccgcggtctcgccctggccctgggtgccggccgggcaggcgaggtctatcacatcggcggtgggtgggaggcgacgaatctcgaattgaccgagatcctcctcgaggcgtgcggcgccccggcttcgcgcatatctttcgtgaccgatcgcaaaggtcacgaccggcgctattctctcgactattcgaaaatcgccggggaactcggttaccggccgcgggtcgatttcaccgacggcatcgcggaaacggtcgcgtggtatcgcgccaaccgttcctggtggacctgacggcaaccggtgggcggacggacgccggtcgcttccggcgatcggcgtccgcggcccgagctaggcgcgcagcagcagggcgtcctcggcgagccggtgctgcatcagcgcggcggcctgcagctcggcggccgtcacgtcgttgacgaacgtgacacccccgatccccaccggcagtggcagccgctgccacccgtcccggtgccggacggtgtcctgcaacgccgcctccagcacctccggcgtgagcagcggatgccaggtcggcaggcccagggcggtcatcaccgcgaagatccggtcccgctgcgcgacgtcgagcagaccccgccggtacgccagcaccgtggtcagcgccatgtccacacacacggcctcgccgtgcagcagagccggcagcgcgcgcatctcgatggtcgggctgaacgtgtgcccgtagtcgacactgcgttccagccggctctcccacagattggggccgagttcctccagcatgccatgggtggccgcgcgcagggcccggacggcggcccggtcaccggttccggtacggccctggaaccgttcctcgatcaggacccgcccgtgccgctccagcagctggaacagctcggcatccttgatcagcgcgatcttgagcatctcggcgagcccgttgctgaggtggcgccggtccagggtggccaggaagcggcggtccagcagggtcagatcagccggggcgtacgtacccagccggttcttgtggccgttgaagttgaccccggtcttcgcgccgacacccgcgtcgatcagtccgaccagtgtcgtcggcacccgcaggaacggcgtgccgcgccggtagaggctggccaccagaccggccacgtccatcagcaccccaccaccgacgacgatcatcggctcccggcggcgggccagtccgaaggcgtccatcgcggcgacgatgcggcccgccgtgtcgaagtccttgaccgtctcgcccacccgcatcaccaggatcgaatgatcgatgccgtgatgggtgaagtactcccggatccgggacccgtacaaggcgtcgacggcgctgtccaccaccacgaaccgccgccgtgaaccggccccgtccgccccggcctccagcaggtcggtggagtccagcccgaacacgtcgtcccggaagcgcacctcgtaggtgatctgcttctgggcccgcacctgccacgagtcgcggtgcgcatccgcgtgcacccctaccgtctcgacaccactcacgtcagcttccctttctcggattctctcgcgttcaccgcggcccggcgggcccactccaggtccgctcgcagccgcgcaccgtggccgtcgcggtagtcgttctccagcaccagggcccgtaccggtgcggggctccccctgagcgcggtcagggtgcgccgcaccccgccctgtcccgcaccgagcagcggcgacggcccggtgtccggcgggccgtccttgaggtggatctggtcggcccaccacggccggagctcggtggccagccaggccgggtcgagtccgtaccggaccgggttgaaggtgtccagcagcagccggaaagccggtgagccgacctcctcgaccagctgccgggcccgcgccgggggcaggacgttctcgctggccagcacgattccccgggcctcggccagcgacacggcccagcgcagggcggctgctgtgcgggtgaaggacatcgcgtcggtgatcgcgctgcgccggaagctgggcacgatgagcagcggcaccccgagctcggtcgccgtgtcggccagccgggccagcaccggctggaccaccgccggctgcgacgtgagcccgatgtcgttgagcaggttgccggccagcgcgagcaggtccactcccgcctcgtcggcgaccgcccgcagctgcccggcacggcccgggccgtccaccagcacgccacggcccgggccgccgaagtcgagctggatcccgtcggcaccgaccgccgcggccagccggatggccgccgcacccgagggcgccagccgccactcggtcagccccacccggcaggtcacgtccgcaccggccggctctgcgacaccggcatccgctcgcgcaccgaccaccagtcgccgcccctgtcgaccaccaggctgtccccgtggtggccggcgccggccgtggcggcgagttccagcgcgttgcgcgcgaaatcggcgggcaccatgtagtcgctgtagtcgaagccggccgggcgacggcgccggatgctcggagtatcgaccatcccggccggcagcacctgcacgatccggacccggctctcgtcctcctcctgggccaccgactccagcagcgccttcgcggccgccttggaggcggtgtacccggagcggccgggcccggcgttgtagaccacctcggacgagacgcccacgaacaggccgggccgggcggcacgcagccccggcagtgccgcccgcagggtgagccacaggccgtgcacgttgatgtccagctgggtacgccattcgtccaccgccacgtcctcgaagacggcgcgccgggccccgtaggagaccgcggcgaagcaggccagatcgacccggtcaccggcgatccgttccaggcgcgcaccggcctccccggtccgggtcaggtcgagcggctcccagtgcaacccggcggcgccatcgccggccggctcgctgcggccacagacggtcacctcggcgccggccgcggcccacgcgtcggcgatgccccggccgatgcccgtggttccgcccaccaccagggcgcggcggcccaccagagtcccgctcatcgatgatcctctctgacattgacctggatcgcgagcttcaccagtcggcggccgtcgatgatccggtcccggccgctccggagcgcggtcatgatccgggccgcgccggccagatcgctgcgatgggtgacgagatcccggtaccggtccgggtcgcgggccagctcgccggccgccgcccgcaggtgcgcgttgcccaccccgcgatgcccgaagagccgggttccgccggaggtggtggtgaccagagccggttccgggaagccgccgcagttggccgcccgcacggcggtgagatcgacaccgggcagcatcgccgatcgcgcgcccgggggcaggccgcccagcacgtcgatcagcacatcggcgccggccgcggccaggaccgcctccagggcctcgacagtcgcgtcccgtggggtcgccagcagggcggccaccggtcccggcagcggtctgcccgccagctcgccggtggtgagcagaacgtccgccggatgcggcccggccgcgctgaagtcccgccccgctgccgtgtggtgcaccagcaccacccggggccgctccgccagccaggtcaccgcagcccgggcggccaggtgacccaccgttccgtcgccgacgatcaccagggtggccgggcggacggcgccgagctggctcagcgcatagctgaccacggccagcggttccagcagcgggcccagcgtgacgtcggtgccgtccggcagcgggagcaccaagccaccggagaccgcggtggccggcagcagcgtccgttcctgcagcaggccgggaacgttgtgcccgagcaggaacgacggatcgtcccggtgggtcgggttgaccgccaccagggtccccggccgcagcgtgccgggcacgccgtcgccggccgcgatcacccgggcgatcccctcgtggccgatgatcggttcgggatcgtcgcgcaggccgcgcagcatctggatgtcggtgccgcacagtcccgcccactcggtgccgaccaacagctctcccggccccggcaccggggtcgggacgtcggcgaccaccacgccggtgccggtgcgcacgatcgcgcggtgccggctcatcgcccgaccaacgcttcccggccaccaccggagtacgccgggaccggccccgccgccagtgcggccagaccggcgccgaccaacggatcggccgtcgccggcgggacgacccggatccgcccggtcaaccagtccggctcccgctcggaggtcaggtagagcccccggcgccgcaggtggtcgtgcaccgccgccgagtagtgcggttccagcccgtgggcgactccaccggtcagcgcgatcaggtcgagttccgggtccaggcagagggcggtccgcagcaggtccgcgatcggggcggtcaccgccgtcagcaggtccgccgcgaccggatcgccgtcgtccagagcggcccggaacgcgtcctcgaagcccgagcccgccatcatccgggtggtcggcccggagcccgcccaggtggccgggtcacgccgggccaggacggccgcgacccgtcgaatgcccggcccggacgaggacgccgccacgtgccccggctcaccgcagtcgcagcgggtcaccaccggcaccccgtcggccagcacggtcgccggcaggtgaccgatctcgccctggaggccggccgcgtcgaccgggataccgccggtgcgcaggtccatcgtccggcaggcgatgccggtgctgatcgtgaccaggcacgccttgcggacgccggcgtcgcgaaccatctcggccaggtgcagcagccccgccgtgacgtcgttgaccacggtccagtgcacgtccggccgggcggcgcgcagggcggccggcacgtcgaacgggctgacctgcggaccccacaacggcgcggaggcgtacgccgtaccactgtggtggtccatggccgcgccgagcgagacaccggcccgcgcacccggctcgacccgcgacgccagctcgcggatcagttccgcctgcaggtcggcggcaccggcgccgggccgccgggcgtgccccggagacggcgtggtgtgcacttcgcccagtccgccgtccggtgaccaccgtgcccagcgcaggtgggtgccgcccacgtcggccaccgtgaccgggtggtgcggtggccgcttcacgccgccggccgcagcagcgcggcccggtcgatggcgccggcccgggtggcggggatggtgcacgcgtaggcgccggcgatcgcgccgtagcgcaggcaggtctccagcggttcgccggccaggtgcccgaagaggaagccggacacgaacgcgtcaccggcgccgttggagtccaccaccggcgcctcgggggccaccgccgcgtaccgccggacctccgtctcgccgcgcaccagcaccgatccgccgtgggcgccgtcggtggccaccaccagccgggcccggccccggtcgatgacgcggcgcatcgtcgcggccacgtcggtcagcgcggtcgccgacaggaacaccaggtcggcgttgaaggcgtagacctcgaagccctcgtaggcgccgtcccaattgtgcaggtcggtggagacggtgaccggcaggtcgttgagctggccgaacacgtgctgcccgggcggggtgatgcagacgtgcacgtgccgggcgtgggcggtgtgcgcggcgatcagggcggccgggtagcggtcctcctcggcttcccggctgccgtcccacagcgacagccggcggccgtccgggccgaccaggttcaccgcccgcttggtgccggcggccgtgggcagggcggcgaacggcagaccgtgccgggtgtggaaggcccggaccaggtcaccttccgggtcgtcgccgagcacgtcgacgtgcatcgtgcgcaggcccagcgtgtgcaggccgagagcgacgttgtcgccggtctgcccggctcgtggttcgatggccgcgaccacgtagctgtcctggaacggcagcggcagttcgggcacgtaggcgatggtgtcgacgccggcgccgccgaggacgaggacgtcggtgtgctccgacatggatctccttgaaaggtgcgggtcagcgaggtcagggtgtggtggccggctcggccgatgcggcgtacaggccggcgaccgcttgggcgccggccgaggacgccaggtcgtccatcgccaccggccggccgtcggcgtcggcgaccggcagctgccagttcgggaactcggtgctggtgcccggcaggttctgcggcctccggtcgccgaccaggtcgggcagccacactccgaccaggcgggccggggtccgggccaggaaccggtgcagggccagcgactcggcgctcatccccggtacggcggtctcgtgctccagcagaccggtgcgccgcaactcggccagccagccgtcacgttcggccgccgcgtcggcggccacctcggctcggggccggttcagcaggcccagccggtcctgcaggtccacgtgctcaccgctgagccaggcggccgtactcggcaggtcgtgggtggtgagggtggccaggcagccggcacgccactggtcggccggcagcggcccgctgcggttctccgatccgccctggtactcgaagcgcagcacggacgtgccgaggatgccccggtcggcgagttcggcacggaccgccggatggacggtgcccagatcctcgccgatgatcatcgccccggcccggaacgcctcgacggccagcaccccgagcatggcctcgtggtcgtagcggacgtaggcaccgtcgcgggcgccgctcccggccgggatccaccagagccggaacaggccgagaatgtggtccagccgcagcgccccgctgtgccgcagggtgccgcggatcacgtcggcgaacggccggtaaccggcttcggccagggtgtccgggcgccacggcggcaacccccagtcctgcccgagcgggttgaagtcgtcggccgggcagcccaccgtgacaccgccggccagatgatcctgcaccgcccacgcgtcggcaccctccgggtcgacgccgacggccaagtcgtggatcacgccgatcgccatgccggacccgacggcggccgcctgggccgcggccatctgctcgtcgacgagccaggccagccagcggtggaaatcgatccggtcgaccagctcgcggcgggcggcggcgaccgccgggccgtgcggggattgcagagcggccggccaggaacgccagcgggtgccgtacacctcggccagcgcacaccaggtggcgtagtcctcgagaccccggccctcgcgggcggtgaaggcggccagagccgcggaccgcccggccgtgcggggtgcccggtagagccgctccagggcgttccgcttgaccggccacacccgagcccggtcgatcagcgcgttccggtgcagcacctcggcggtcagttcgtgtccctgacgggcggcccggtcgagttcggcccgcaccgccggttccgcggtcgcgtactcggcgacgtcggccagccgcagatacatcgggtcggcgaaccgccggctgcccggccggtagggcgtggggtcggccaggcggtccggcacgtaggcgtgcatcggattgaccagcacgaacgacgccccgagccgggccgaccagcgggtcaggtcggccaggtcgccgaggtcgcccatcccccaggaccgttcggacagtacggagtagatctgcgccagcatcccccagtgccgccggtccggggtgccgaggacggccggagccacgatcaccggcgcggcggcggaccggtcgcccacccgtacgcgcagcgtgtggtatccgatcggaaggcggccgaggtcgttgcgcgggtcggccgtctcgtgccggccaccgtcctcggtcgccaccacataggcggccccggccaccgggtggactcccctggccggttccccctgccgcaccaccacgcaggacggcagcagccggtgccgggcgtcgtcgtccgcggcacgcagcgcggcggcgatcgcggggccggagctcgcgtccacaccgagcacagccaggatccgctggatcgtgtcggccggcaccgtccgcggctcgccgcggtcggtggtccagtcgaccgacaccccgtaccgtccggccagctcgatcagcgcggcatccgtcgtggtggtcatcgcaggcttgcctttcggtttccggcccggacggcgggcagacgttcgagcaccacggccacgccgtccgcgtcgttgctgacagtgatctcgtcggcgcggtcgcgcagccgggggtggccgttagccatcgcgacgccgtacccggcccagtcgaacatcggcaggtcgttgggcatgtccccgaaggcgatggtgtcggccccggtgaagcccagttcggcggcgagaaaggccaggccggtgcgtttgctggtgtcaccgggcagcagttcgaccaggcccggaccggcgtgcatcaccgacagcgccgcgccgcagacctcgtcggcgagtgccgcgagcgtgtcgtcgtcgtggtccgggtgccggatcagcaccttggcgaccggcgcacgccacaggtccggctcgtcgacgagctgccagcgatgctgctggtagggggcaccgaaaccggcggtgaccaggaactcggtgcccaggccggcgctcaccgcggccagcgcgagcggaccggtccgctgcgcgatccggcgcaccagctcgcgcaccaggtcggtgtcgaggctgcggctcagcagcagccggtcggtgccgaagtcgtacacctgggcgccctgaccgcagaccgccgggccggtgtagcccagcccggcgagcagccggcgggtgtcgatcaccgggcggccggtcaccgcgaggtggatcatgccggccgcccgggcgtcgcgcagcgccgcgcgggtccgggcggacacggtcaggtcggagcgcagcagggtgccgtcgaggtcggtcgcgacgacccggtggtcgcgcgggggtgtggtgccgatgccgtccatgtcagcggcccccggccccgaccggctgcgccgggtgcggctgaccggcgaggtcggcgaggtgtgcggtggccggtggggcgtcccacgcgtaccgtccggaggccagcgtcagcaggaacaccggtgacggcatcggcaccgtgggcagcaccgtgctgaaccggccggccgaaccgtgcatccggtgggcggtaccgccgaccaccagggccacctgctcggcgcccggcgcccggtactggatctcccagccctgctcgtgcggccgtacccggcagcgccggcgcagcgacaccgcctcgctgccccggtcgcccagcagttccgcgacccgcacgcaccggtcgaagtcggcacgccggtacgcggcctcgtacagtgcgccgagcgcgcccgggtcgaccgggccgcagcggcgcagcgtctccaggtcaccgaggcggatcgcttcgcgccggatctgcggcaggtgggccgcccactgcgcggcgtccaactggtcgaaccagccgcacccgatgacgtgctccgggtcggccgctgtcggcgtgccgtcgagcagcttcgcgaagtgggcgagccgtcgccgggacacctcggcgtagcggaaggtgcgggcgagttcggcggcgttgccggccagccgccggtactcgcccggttcgtcgcggtacatccgcagcgcctcccgcatggtacgcaccagagcgccggtcagacgttcgtcgtccggggtgaaggagcgcggcagggcgaatccggtggccagcggatggtcggtggccagctggtgccggtagtgccgggtcgactcctgcgcggtcccgatcggcaccgcgccgcaggcgcacagctgcccctgggcggtcaggaaggtgtccagttcgtacttggacgggaacaacccgaagtccgccgccaccgcctcggtgaacagttcgtcctcgtcggccatggtccagaagagccgcacctggccggggtgccggtcggccaccgcctggaaggcggggtcaccgatcctggcgccgccgccgccggccgaggtggcgcagcgcagcacgaagttgacccgggtgtcggtggcgaggatccgctcgaccgcccggaagagctccacctgacccttgtggtgcggcgagtaccggcccacgtggtagaaggtcggcagcgccgggtccagcccgagcccggagaggtacgccgcccggtccacctcggccgggtcccgccgcagccagttctccggcagcgcacagccgccgacgaactgtttcgccgcgttctcccggaccacccgggccaccgcggtccgccggaacgccgcctcgtacggggtgtcccggaacgtcgagtagaaccgccgctgccccggggtcaggaagtccaccgtgtcgcagtggtcggtgatcagcgcgaacaggcccacgtagtcggcccgccgccgcccgctggagagccgggtcgtcggcaggtatccggccatcgccgcgcccagcgccgcctcgcgggtggccgcgggatggtcggcgccggccgcgaccgggctctccacatagcggtccaggtcggtgccggcgccgaagtgctcgagcaggcggtccacctggggccggtacacacccaggtcgatcggcatgctgctggccaccgtggacatcacccggaaccgcgggtcgccggccagcaccgggggcaggaggtagtggtagtacggctcgtaggcctgcacgacggcgggctcgtcaccggccagccgggactgcaggaagcgcagcccaccgacctggaacaccagcggtttgaagtacgccaggtcgctgccctcactcgtgccggccgggtagagccgctccggcagcagatcgaggtactcgtcgctgagcaggtagatgtcgacgccctcgtgccgcagcaggtgggcccgggtgaccaggggcaggcccagttcgcggggctgccccgcccagacgtcggggtccgggaccacgggaacgacatgctcgtcccggtagtcgagttcgaccaggtcgtaccgctcggcgaggtacggcaggcggccgtgcgccggggtgacgatcgaggagcggtgtccctgggcggcgtagtggcgggccagttcccaggccagcggggcgagcccgccgcgcatcatccctacgtcgaaggcgagggcttcgaaggcgaagctcaccacgtgcacgattcggctccttccggcatgggctgtcgcgttccgctgtcgtacatccgcagcagggtgtaggccgcgagcgtcgcggcgtcggtgatccggccggagccgaccaggtcggcccagccggcggcgtccacggcacgctggcgcatgtcggactcggtgcgctcccgctgagagcgccccgctgtgagctgttcggccaggaagacgtgacagccctggctggcgtagccgtacgcgacgtggatgcgccccagcggtgtcagccggccggcccgcagcccggtctcctcggccaactcggtacgggcgagcaggtcagcggcaccgccggcggcgtcggccggccacgagccctgcgggaactcccagaaccgcccgccgaccgggtagcggtactgctccaccaggtgcagcaggccgttgtcccgcgggatgatcagcgcgtaatcgggtttggtgacgaccccgtagctgcccggcgagccgtcggcgtgcacgatgtcgtcctcgcgcacgctcatccacgggttgcggtacacctcacgggatcgcacggcccggacggcgccggtcatcgccgggctccggtggtgacctgctggacggtgccgtcctcgagcaccacggcgccgtcgatctccgcgccggccggcaccaccgctccgggcagcagcacactgtcgcgcaccgtcgcgccgggcccgatccgcgccgccgggaagagcacgctgcgctcgacggtgccgtggttgaccaggtccgccggtacgacactgtgccgcacaccgtcggccgaggtcaccagtgcccgggcggtccggggcgccacggtccacggcatggcgtcgacggccagcgacggcggtgtgcccaccagcgacaggtgggcctcgtgatagcgctcgacggtgccgatgtcggcccagtagccgggcaccgggcagccgcggatgtgctcgccggcggccagcatcgccgggatgacgtcgcggctgatgtcgtgctgccagtcggtgccgtccagcagttccaggtagcggtgcagcaccgcggcgtcgaacacgcagaacgcggcgaacaccaggtcgctggtcggttcggcgggcttctccacgaacgagaccagacggttacggtcgtcgaactcgaccatcccgaacaggtgcacgtaccggcggtcgatccgctggtaggacacggtcaacgcggcaccggacgcgcggtgctcggcgatcatcggccggtagtcgaagcggtacacgtgatcggcgtgctgcaccagcacctcggtgacatccggcccgaacaggtagggggccttgcggatcagcgcgtccgcggtgccccgctccggtggcccggtcggcggctcgtactccaccgggatcccgtcggtgtaggcccggtcgtacggcccgaagtgcacccggaaccccggctgccaccaggtgcgccgcaggtcgtccatcagctgccgctcctggtactgcgacagcagcagcacctggtccaggccggagtcgcgggcattggccagactgaagtcgatcagccgggccgcgcccccgaacggcaccagcggcttgagccggcccgcgccgagcgctcccatccgccgtccctcaccaccggcgagcagcaccgcccgtacgcccgtgctcatgccgtcacctcgtcccagacggtgcgcccgtcactgagggtgagcagcaggtcggcacgccgggttccggccggcagctgtccggtgaaggtgtcgccggtcggagccatcgcggtcacggtgaccgttccgcgcaggggttcggccaggtcgggcaagaccagttcgacccgttcggcggacggcggacggtagtgcagccgaccgtcgcggtcgatgcggccgcggccggcgagccgggcccgccactgcggcacccgctcctgccggtgctcctcggccagctctacggtccgcgcgcaggccgggaagtcggcccgggcccaggcccgctcgaagagtgccgccagggcgtcgaggtcgtcgggccggcagcgcaggtaggcgtcggcgtcgccgtgggccagggccacctccgcgatctcgtcgcggtgcagcgtccaggcgtccgcgggcagctcgtcgaaccagccgaaccgcagcaggtcaccgaccggcaggcggggggtacggccggcccacaccccggcgaacgcggcctcgtgcgcctgggccgcccgccgccaggtgaactcgcgggcccgggcgacggcgttggcggacaaccggcggtactggccgggctgctcgttccagagcgtgacggcccggcggatctgctcggtcaggccctggaccagcagcggatcgtcctcggcgaacgagcggttgacggcgaatccggtggccgtcgccgcgtccggcccggtcagcgggtcggcgacgtgaccgaagtgcgccatccccagctgggcggtggcgatcggtaccgcaccggcagccatcgcctcaccctgggcgatcaggaaggtgtccatctcgaacttggacgggaagagacagaagtccgcggctcgggcgtactcccgcagctggtcctccggcacccggtgccactccagattcacccggcccgggtggcgggccaccacctcgtggaagagcgggtcggcgatcccggcgtcgctgaggcagcgcacgatgaagctggcccgcacgccgccgctcagcacccggtcgacggcccggatcagctcgacctgccccttgtggttgaccgcgtaccgggcgttgtggtagaaggccggcaggtccgggtccaggccgagcccggccagcaccttctcccggtcgaccgggggcagctcgccggtcacccactcgtcaccgacggcgcagccgccgacgaacgtcttgtccgcgttgcgccgtaccgtccgcgacaccggcagggtggcgaacagctgcgcgaacggggtgtcggcgaagcaggtgtagtagtcgcggtgccccggcgacaggaagtcgatccggtcggcgtgctcggccaccaggtcgtagacccgcacgtggtccggcgggtattcgtagtgcaggtgggtcagctgctggtactggctcatcgccacggtgtgcggcgaacggctgccggccggatcgtcggcgggcagcgcgttcggggcgccgaggaagccgagcagccgcgccacctcggcccggtacaccgacttgttgatcggcatgttgctctgcaccgtgctgaccacgtgtttggccgggtccgcggcgaaggcggccggcatcaggtagtggtagaacggctcgtgtgcgtgcacgatcgcgcgctggtcaccgaagtgcgacctgatgaaccggatggccgccacctgataggcgagcggcttgaagaagaccagatcaacccccttgctctcgtacgggggatagaaccggtccggcaactgatcgagcagttcgttggagaggaagtacaggtccacgcccgccagccggatccgatgcgcggtggtccgcagggcgatgtccatctgggccgggaaccgttcgccccacacgcgcgggtcgagcaccagcggcagttcgtactcgtcggtgccgggcaggtcctcgacctcgtgcagccggcgcagatcgtccaggcggccgtgcgccggtgtgacgatggagacccggtgtcccaggtcggccaggccacgcgacagctgccagagatagaccgaggtgccgccctggatgaaccggtggtcgaagccgccgcattcgaagtacgtctcgatgatgtgcatgtgctcagctctccccggtgaccggcggccggtaggtctggaggacgtgtcgaaggttgatcgccgcgtggtagtgctggtcgtgggcgtacgcgtagtccagttcgtgcaacagacggcggagccggaagatccgccaggcggggtgctcctcggccgcctcgccgccgtcggcataaccggacagcagcatccggcggacctgtccggcccacaccgacgccgcgtcgtgcatccgccgcagcgcggtgagccgggacccggtccaacccggcgtgtccggggtctgcccggcactgatcagcagcacggtccggcaggtgtcgtcctggtcggcgccgagccgcagggccgcctggtgcacgaactcgtcggcggtgaagatctccagcccgcgcagcagcgccaccaggtcctgccacggtgactgggcggcgccgagcgggtcggccgggtcgggggcgggcgtggacaggtcgatcacacacagccgccagccgtccggtgtctgccggcgcaggatgtgcgacaggtgcaggtcgccgtgcgacgggccggccggccacggcacccgcaccgcgctggtggtggcctggtccagttcgccggtcagggcggcgacgaccgcctcgcgcaccggccgggggtaacgttcgtcggcgctgatccggcaccccagcgccgccacccgctcggcggtctcccgcaggtaggcgttcaccgggaacgtcggcgcgggttccagccgctgcgccagttcggtatggaagtcgcggaggaaccggccgacgccgggcagctcgcccgcgatggaccgctgcgcggccgtcaccgcgccggccggttcggtgccgcccagcagcgccggccacatcgaccggatgctgtgccgcagcggcaggtcgaggctgtcgccttcggcataggcgtagagcaggcccagcgggtagcggcgcccggagggctgctccacgtagtggtagtcgccggcccatcgctgggtacggccgccgcgatgcatcagccgcagcagatgcggttcccgggtggcggccgacaccagccggtacgccttgtggatgtgcagtgtcccgtccagatcggccagcgacagggcgttggtcgaccacccggggtcgaacggccgggtggctcggaacggcgcggggtcaccgtcgaagacgatcagatggccggctgcggtgggtagtgccagccgctcgcgcatcgcctggaccacggcccggtcgtgggcggcgtcgccgacggcctcccgggacggatcgtggcgcagaacggcgacgaagtagcggctctcggggttccgttcggccgcgacgatcagcaaccgggacgggccgaggatcgcctcgtcgaggatccgcaccccgccgggaccgcgcagatcctcgtgcggccagtcggcggtgcgcagcaggctggcgaggctcacgtcgatcgtgctgaccggccggggtgtcatgccgtcacccgcccggcctcggtaatcgcccggtccagcaggtccaggccgcgcagcagctcggtctcgtcgatgacgaacggcggcgcgagccggatgatgtgcccgccgatggcggtgcgcagaccggcgtcgagggcggtggtgtagacccgccgggcgatctccggggccggccgccggctctgccggtcgtgcacgaactcgagcccgtgcagcaggccgatgccgcgcacgtcgcccaggtgcgggtgccggtcgtgcatctcggccaggcggtcggccagcaccgcgccgaggtcccggacctgctcgatcagccggtcgcgggagatcaccgagagggtggcgtgggcggcggcgatcccgagcgggttgccggcgtaggtggaggcggtcgatccggcgagcccggcccggggatgccgcagcacctcgtcacgcccggcgagcacggcgaacgggaaaccggacgcggtgcccttggccaacgtgaccagatccggggcgaccccgatcgcctcgctggccagaaaggttccggtccggccgccgccggtgagcacctcgtcggcgaccagcagtacgccgttgtcccggcacgcggccgcgatctgctcccagtagcccggtggcggcacgatcacgccggccgcgcccagcaccggttcgaagaacagggcgctcacgttgggtttctcggcgatgtgccggcgtaccagggtggcgcatcggacctcgcacgacggatagctcagctccagcgggcaccggtagcagtacggggcgtaccccagcacgctgttgccggcgaacgactggtcccccacgtcccagtgcaccagcatgcgggcgcccatcgtcttgccgtggaagccgtgccgcagtgccccgacccggttgcggccgggttcggcgacggcctggaccgtccgcagtgccgcctccaccacctcggcgccggtcgagaagaaggcgagcgtggtgaggtggtcgggcagcagttcggcgagcagttcgcagagcgcggcgcggtcggcggtcgcgaagtcgtggacgttccacagcttcccggcctgttcggtgagccgggccaccacctcggggtggcagtgcccgagtgactgggtcaaagtaccggcggcgaagtcgaggtattccacaccgtcggcgtcgcgcagggtcgcgccgcggccctcgacgaacacccgccggccgagcgccgcctcttcggaggctcccggagccaggtgacgcgactcccgggcgagcaggtcggcctgcctgctcaccggaaccgccgccgggtcgcggcgccggtgtcgaaacgaaccggctcggaacacatcacgggtcactcctgaaggggatagccgccgcatccggtgagatgggctggaagttcggggttcaagcgacgtcggcgtcgctgcaccgcccagcgagccgcacactcagccgggccggatcggaaccgtcgaggcccgatgaccgcgaaatctatggcggtgaaaccggcaccgcaactggacctgaaagtttcagcaagttcttgcatcgttcaccggccgcccctccgcaaccccgcccaccatccggccccacccgccggtcccgtctgtaaccgcattcatctggccgaatgtcggaaaagccggctggtaatatatcgaggatcggcgatgggtttgttgcccgaaacaacaaattatgacgccggtcactccatatcggacgggaaaggtttcgcggtcacatttcgaggaccgggcacggcggcttgacgagtgccgccgcaatcgcattcaatgctcacttggctgatcccgcaccgcacagcggatgaccgccctccccctaccgagcgatcggccgtgcccctcagcacctcggacaacgaggatggccggccgcactccggcgcagcgcggcgccggccgcccgcggattgtcacaccgtcgacaacatcctccggccgactgttcggattgcttccatatagccggtcgccgagaccggcgcgacattgtggaaactcggttaattgatggtaatcatcaatttcaaaatgttgccgccacgacatcttccggaaaagaaacgaggatccgtgaatcatctcgactcgccatgcccgggtacgcccggcatgcccggccggacggcacgaccggcatgatcgtcgccgagcacctcagcaagcacttcaagcgctaccggcgcgagccgggtctgcggggcagcctgcgaaccatgttctcggcccggtacgacgtggtccgggccgtcgacgacatcagcttcgaggtcccgtccggtgtcaagatcgcctacatcggggcgaacggcgcgggcaagtccaccacgatcaaactcctgaccggcatcatgcgcccgaccaccgggcgggtccgggtcgacggcctcgacccgcaccggcagcgcacccgggtcgccggccggatcggcgtggtcttcggccagcgcagccagctctggtgggatctgccggtcctcgactcgttccgcatcctgcggcacgtctacgaggtgccgcaggcggtgtacgaccggaacatgcgcctgttccgggaccggctggacctcggcgccctcggcaacaccccggtccgccagctgagcctgggccagcgcatgcgggccgagatcgccgcctcgctgctgcacgacccggccgtggtcttcctcgacgaacccaccatcggcctggacctggtcctcaagcaggcggtccgggacctgatcaaccacatccacgccgaactgggcaccacggtcatgctgaccagccacgacatcggcgacatcaccagcatctgcgatcaggcgctggtcgtggaccgcgggacgatcgtccaccagggaacgatgcgggacctgctgcggtcggtggacacccgggcggtcaccttcgagtacgccgccggcagcgtctccgaggccgccgcgctgcgcatcatcaccgaaggactgcccgaggtggacgccactccggccgagtccggccggatccgggtcgagttcccggtggaccgctggtcggcccggcaggtgatcgccttcctgctggaccggttcgacctgagcgacgtgctggtgccggacgccgatctggagacactgctgcgccgcatctacgccgggtcgcgcccggagccggtcaccgccggggacggcgcatgatccgcgccgcgcgccggtacgcgccgttcgccctcgccggactgcacgccgtcacccgttaccgctcgaccatcgtcctgagcgcactcacggcggctgcggccacctcgttgcaggtgttcctgtggcgagccgtctacgccggcggaccggcaccggccggcctcccgttcgcacagctcacctcgtacatcgtgctcgcgcaggtgctcgggatgctgcacaccaaccggatcgacgagatgatcgccggcgaggtgtaccgcggggacatcgcggtctccctggtacgcccggcgaactacgcgctcagctgtctggcggtgaacctgccgaccgccgcgctcagtgcgctgctggccggcgccccggtgctcgccggtttcgcgatgttcgcgtcgctgcccgctcccccgcccgccaacctgctgctgttcgccgtcgcgctgctgctctcggtgatcctcgccttcgagatcaacttcctggtgggtctcgccgccttcgtcacgaccaacacctggggcatccgtacgatcaagaacgcgctcgtcgccttcctggccggccaggtcgtcccgctcgcgctgttcccggacggcgtggcccggctgctgcggctgctgccgttccagggcctgatcgacagcccgttgcggctgctgctcggcggctactccggcggttccggcgccgctgccatcctcggtgtccaggcgctctgggcggtactgctgtacggcgtgctggccctggcctggaaccggtcgctgcgcagggtggaggtgctcggcggatgaccgtctccacggcgcgccggtacctgcgcctcacggcggtgctgtgcggggcgagcctgcaccggctcaccgcgtaccggatggacttcctcatcggggcggccagcttcgtcatccggatcgcctgccagatcgccctgatcggggtgatcttccagtacgttccggcgctcggcggctggacccgccagcaggcgctgttcctgctcgggttctccctgctgccccgcgggctggaccggctcttcaccgaccagctgtggatcctggcctggcagctggtgcgcaccggcgacttcttccgctacctgatccggccggtgaacccgttctacgcgctgctgtccgaacggttcctctatccggacgggttcggggagctggccaccggcatcgccatcgtggtcaccgcggccgggacgatggacctgcacctgaccgtggcacagtggctgctgttgctgcccctggtcctcggcggcgccctgatccacaccttcctcaaggcgttcctggcctccctgtcgttctggatgaccagcagcctcaacgtgatggtggcggtcaaccagctcagcgagttcaccgcgtacccgctcaacctctaccacccggtgctgcgcggggtgctcacctgggtgctgccgttcgcgttcaccgcctacctaccggtgcgctacctgctcaccggggacgccgggccgctgctgtggatgctgccggtcaccacgctcaccgtcctgctggggtacggcaccttccggctcgggctgcggcgctacgagatgcccggcagctgaccggttcaccgcgatcgggggcccgcgcgctcggcgcgggcgccccgatcatcccggtctccggtcagccggtgaggtcaccggcggcgcccacaccggtggccgcgagcagcttgcccgaggcgtcccgttcggtgatcaccacctgaccgcgcaacgccgtggcgagacggtgccggtcggcgtcggcgacgcggaaggcgccgtaccgccacagcttcgggaaccggactcgctggctctcggtcaggccgtcacgctgcgcggtgagccgcagggtccggtacgcccccgccagctccccgccgaccacggtgatccccccgaccggggcgtaggccagctcgtacacccgcccgtcggtgccaccgccgaccggctgcaaggtgctgcccacaccggtgttccagaccaccgtgtcccggctggcccacccggcgcgcgaggtcgtcacatcgatcccggcgccggccgcggtccggcgggtcaccggcagcaggcgctcggccaccccgtcgagcagccacacctcacggccggcggcgaagtcgatccgctgatcggtcggctggtccttggtgtcaccggcgtgcaggacgtagctgaccccagtggcgccgtcggcgagcggcacccggaacgtgacaccgtaggcgtcgcgcccggacggggccagcggcgccgtccactcggtgggctgggccgcgccgtcccagacgtgcaggccccatccggtgtagtcgccgtcggcgcgccggtagtgcaggacggcggtcttcgggtccggttgcgggtcgggccggccggtggcgtcctgccgggacgggtacaccgtcgcgtcgcccgctttcagccagatctccggttgtcggcccgggtcgacgaaccggtcctgctggacgtccttgacgccgttgccgtccaccacgacgaaaccggcgttcttggcgccgggcttgagtctcacccaggcgaacgcgccgtactcgtcctggccggcgaacggctgcccgtccgggtaggtggtctgggcggacgcgtcgatgtcgccgaaggcgtacaaccgccaggcgccgtagtcaccggcgggccgctggtagtgcaccaccatccgctccggcgcgacgtgggtgtccggggtgccgacccgcagcgacgaggtggagctcgcggtacgtccgcgaccgtcccggaccaccgccttgtacctcacggtgaccccgccggccagaccggtcaggtcgtggtgaacctggtacggggcctgccgcgcggtgccgatcacggtccacgggccggatccggcctgcgccgcgaaggtcaccgtggccagcggatcgccggtgacgtcggcgaccagatcggcccgcgacggcacggacgcccccgcggccggtgcgctgatccgcacggtgggccgggccgacgggaccgcgatggggctgccgccccggtagaccaccgcggacagggcgggcacggtcaccgtgagcttgccgtcggagccggtggcggcggtaccgcccgcgcggtagacgccggtgaaggtgctgcccggcgtggcggtgccgacggtggccgtctgtgcggtggtggcgttgttgaccgcgaccaggtattcctggcgtcggaccgggtcgacccgggagaacgcgaagatgccggcgccgggcgccgcgtaccgggtgatctgcacgccgtcgcgtagcgccgggttcgccttacgcagcgcgcccagctcggcgatggtgcggtagagcgggtgcccggtgtcgtagttgtcgctcgcgtgggtccggtcggtgccgatcaggtcgtcgtcgaggtagtccggcgtccggctggcgaacatgtcctgccgggcgtctttgtccccgcccggcccggtgaagccctgctcgtcgccggagtagaccaccggctgcccgcgggtgaggaacatcagctcgtgggccagctggtcgcgccgcaggtaactggtccggtcggcgccgccggtggtgatgaacgagccgatccggccgatgtcgtggttgccgaggaaggtgggcatccggccggccccggtgtcgcgggcggtgtagaggtcgtcgtgtcggtaaaggtcggccagcgcggtggccggcgtgtcaccggagacgaacgtgcgggccgccgactggaaggagaagtccagggacgcggccaggccgccctgccggacgtatcggctctccacctcctggtcggcgctgaagacctcgccgaacatgaagaagccgggtttgccggcccgtcgcgcggcctgctggatggccgggttgaactgctgccagaactcgatgttgctgtgcttgacggtgtccatccggtagccgtcgatgtcggcgtcccggatccagtcggcgtagatctcggtcatgccgcggaccacttcgggccgctcggtccacaggtcgtcgaggccggtgtggtcgccgtactcgctgttctccccactgaacagcgaattgccgcggttgtggtacatggtcgggtcgttcagccaggccgggaccttcgccgtggcgtcggcggggctggcgaagaccggcgtgtacgggaacgactgcaggttcaccttcgggaacggccgcgagccgtcggcgtagttgtggtcctcgaacggccggccccggctgtcccggtacggggcgtcggccttgtccacgtacgtgctcttgccgccctcgttctggatgacgtcggcggtgtggttgacgatgatgtccaggtagatcttcaggccccgccggtgtgccagctgcaccaggcgcttgaggtcggcgttggtgccgaagtgcgggtcgacctgggtgaagtcggtgacccagtaaccgtggtagccggccgaggcggcggcgccggtcccctgcaccggccgattcttgaagaccggggccagccagatggcggtggtgccgagcccctggatgtagtccagcttgtcgatcaccccctggatgtccccaccgtggtagaagcccttgtcggtggggtcgtacccggtggagagccggtcgccggagagaccgccggtgtcgttcttcgggttcccgtcggcgaaccggtcgggcaggacgaagtagaactgttcggcgggtgccggccggtcggctccccaatgggccagggccgcggcgctcggctcggccgcgccggccggcgcggccgacgcccgccacggtggcgccagcagcaggggcaccaccaggccgagcgccagcacggcggacaggcgacgcatgacgtcgcgatgacgggacagaaccaagacgcggccctcctcggggcgtgacggggaacgtggtgcggtgcccgcgggggcgcccgccgtccggagaggccggcgcttcatcgatggccgccagcggcgtcaccgcaccgcacgaagctagcaaactcttgcatcacgtggaagcacttgcaaacagccgggaagccgtctgtcgccagccgttaacactgtggacgcaccgttgcgatgggagcgcccccagcaacgatgtctctcgatgccgtcagcggggaaggcacttgctgcgggacggcctgccactcggcacgcatccgcccggaaagcgccgcaccggcagactccggccgcacctcgcggatcaacccgccggccaccagatcctcgatcttgagctgtacgggcacgcacagccacacgaacgcttcgtcgatctcgtcatggcgctcctcggtatcgtcgtcctcgtcggcaaggtcgtccgcgtgttcggcacagagcaggcggcaggcatgaatgccgataagcaggtcttcgaatccatggagtcgcgagtgctcaggtgagccgggtgtcagccgatcagcagaagtgcggaaaccatctcggacgggactggtggtgtgatccagaggaacaggcaggtgtgtgacgcccggaacgagtctgtcgcgctcatctcccgtgtagtggccgagcgtgccgttgagccgctgttccagcccatcgtcgacctcgatacccgccggctggtgggggcggaggcgcttgcgcgtgggccggcaggatccccgctggagttcccggaccagttgttcgaggccgctgcgcgggttgacctggtgccggagctggaccagttgtgcgccgcccgggcacatgagatcgctcaggcccccggagcggtggtgccaccgctggtgttcatcaacaaggaacccgccggggcggatcggccgctcagcgaggacctgcgattacggctcgcctcgatctcgacctaccgatacgtgctggagttcaccgagcgtgccctggcggcgcacccgtcggcgctgcttgaggtcgccgcccgggcgcaccgcaccggcggtgcgctggcgctcgacgatgttggtgcggaccggctgtcgctggccttcctgccgctgttggagccggaggtcgtcaagctcgacatgcacctgctgcgcgacccgtactgcgcacacaccatcgagacgaccgcgctggtgtgcggatacgcccagcggaccggtgcgatggtgatcgccgagggcatcgagacggagcaggatctccaggtggcacgcgccttgggcgccggctgggggcagggatggttgttcgcccggcctgggccgctgtccgccgtgcgggattggccggtcgacccgtcggctcggttgcgtgctccccgccctgagttgtacgtacccggtgccagcccgttcgatatggcctcggctcgccaccgcgcccggaccggggaccggcatctcctcgacgggctcaccgcacacgtcttgaggcaattgccgttcgccggcccgtacggcgtggtcctgggcgcgtatccggacctcgcgacgggacacggctggattccgcggctggccgacgcggcatcgaccgcggcgctggtgggtgtctccggtcccggcccgggcctgccagctccttcgccgattcgcacgtcgatcaccgatggactgagcggggtggagtcggaggcggcgctggtgatcgtggacccgcatgtcaccgtggctctgtgcacgcgacggcgccacgacgatgccatcgacttcgtgctgaccttcgatcccgacgaggttcatgcggtggcgcgaacgctgctgcaccggctcggcccgcaggatctacccggttaggaccgccgagcgccgggcctgtccccggtggtcatagcactcgaacaatccgcggattctggtgaggaagccacggccgagaaggcgaccaggctgtcgggaatccggtgcccggacggcccgaggtcacgatggcgtcgcagccatccgaaagatttcgaaaatgtttctgacctccgttgaccgcgcctggtgttagcggtcacacttcgcctccaaggttgcacgcccgccgcgacgcgggccgaacgagaggcacggaatggcacctgacctgccccgccgcttggccagggcgacgctggccctggcgatgaccctgaccgccgccatcggaacattgttaacagcaacaacgccggcaacggccgccgccaccacgtccaacctggtggctccggcaccgtacggcgctgacccgtggatgggttactacaacggcaactactacctcgccgccacgacctggaacaaccaggtcgtggtcaagaaggcggcctccgtcacccagctgtcgggcgccgcctacagcgtcgtctacaccggtgccggctcaaccgtctgctgcaacgcctgggcgccggaactgcacctgctcgacggcccgaacggcaagcgctggtatctctactacaccgccggcaccgcggcgtgctgcgacgggcaacgctcggtagttctggagagcagcggcaccgacccgatgggtccctaccacttcgccgcgcagctgccggtgcagaacaacggctgggccatcgacggcagcgtcgccacgatcgccggcaaactgtatttcttctactcggcctgggtcggtgaccagcagagcctcttcatcgccccgatgagcaacccctggacgatcagcggcgccgctaccaggatcgccgcccccaccaacgcgtgggagacgtccggggccaaggtcaacgaagcgccacacatcctgcagcatggcggcaagaccttcctcaccttctccgccagctcctgcaccacgccggactacaagatcggcatgctgaccctcaccggcgccgacccgatgatcgccacttcctgggtcaagaagagcacagctctcttccagcgctccgacgccaacggcgtcttcgggcccggtcatcacgccttcttcacgtcgccggacggcaccgagacctggatggtctatcacgcgaacgactcggccacgcagggctgcgccggcacccgtaccgcccggatcaccaaggtgaactggaactccgacggcaccccgaacctgggcacgccggtcgcctcgggcaccaccatcacggcgccctccggggaccccggcggcaccgtcaccttcccggttgcgggcacccggtatcggctcgtcaaccagagcagtggcaaggtcctggacgccaccgactgcggcaccgccaacggcaccggcgtacggcagtggagctcgctgggcaacagctgccagcagtggagcttcacccgggtggccggcggctactacaccatcaccagtgtcaacagcggcaaggtgctcgactcggtcaactgcggtacggcggacggcgccggcatcgacctgtggacagcactcggcaacgcgtgccagcagtggagtgtcaccccggtcggtacccgctacctgatcgccaaccgcggcaacggcaaggtgctcgacgtggcggactgctccgccgcggacggcgcggccgtccgtcagtggactgccctcggcaacaactgccagagctggaacataacgccgtaacgaccacgtcccgatcacggtcacctatcggtgaccgtgatcgtcgctttcgcccgccggtgcgggacgctgctcgtcgccacagcgctcgccggatgctcaagcagcaccctgaccgagcggctgacccgagttgcggaccagatgatgaaagcagtggaattcggcacccgcgtcggtcaggcggaagcctcggacagggggctgcacagccgaccgtcggcatccgcgtcgattctgtgccgcccctccgcggtgtaggtggcgtgccggttcttgccggcggccttcgcctcgtacatcgccaggtcggcgtgcctgatcagggactccgcgtcatcgccgtcggtatacacggcgatcccgatgctcatgcgcacgggtagcgtgacgccgtgggtcgcgatcggtggccgcagcgccgcgatgatgcgatcggcggccgtccgtgccgtgtcctgatctgacgacggaagaagcacggcgaactcgtccccgcctaggcgtgccactcgctgagcttgcgcggcggtgtccctcaggcgccggcccacctcgaccagcagcgcgtcgccggccgcatgaccgaaggtgtcgttgaccggcttgaaaccgtccaggtccaggagcaggaccgtcgcatcgtgctgcgcgcaggccgctgacacgtcctcgtagaacagcgcccggttggccaggccggtcaacgggtcatgggtggcctggtgctgcagcatccgacggtgctcacgcagcgagtcgatcaggtgcgtgttgtcgcggaacgcgatgatctgccggccgacgaccacgacggtcaccaggacggacccgatcaccatcgcggtgttctggcgcccgttcagggtgtggatcagcagcagcgagtcgatgacgccgaccgcgacgtacggcatgacgctgaaggtgctgcggcgatccgccgcagcaccggccgcggccggcggttgcccggccgccaccacgacgagaacaccctccaccgtgctgatcagcggaccaacgcccagccagcgggcgtcgtgttccaggattctggtcagcgctgaagccagtgccccgatcaggacgagcaggcccaacgcctgcagcgaccggacggacaccgcgtcggtgccggcgagcatgagcttgaccacggcgaggacggcgcccatgcagatggcgcacaccagcaggggaccgatcaccgtacgcaattgcgggtccgacccgatcatggggcggacctggtattcccacaacacggtcgccgccactaccatgatcgtggcggcgtcgaggccgagtcggaccgcctgaccgcgggcgcggtcagcgacgggaagccgcagcaatgccccgatcatcagcaatagcgcgactgcgatgaaacttaccgccacgacgagaacagccgccgcggccggcaacgccccggtgttgaccgcgttgatgaggcaggcgcccggagtcaccagagctgtgcctatggcgatctgggtccagaaccgtcggccgtccgcggacgccgcaccgcgccgggcgatccgccaggccgcccacgctccgaggagcagagtgacaccgcccgggatccacgcaacgttcggtagccatccggggttcagggcctgcacgaccagccacaacgcactggtggcacacgccgccagcagaccggcccagacgaagcgctggtcgcctcgcggcgctgaccggtgtaccgctccgcgtccttgcaccctttccaccccctcctgctctcaatcgccagacctatcggcggcgcgcgaagcggtatgagagacaggagccgacaccaccgccggatcatgcagatggccggccagggacacgcaggcgcgacgctgcgcgagctgctcgacgatcgaccgggtatcggccaatgaccgggccagccgcgccgagcccggggtgaccagggtgtccccggctcgcagcgagcgcagcgcctgctgcaggccgggacgtggacgcgccggtcaacggctcgtccaggaagatctgcgaggcggtgacgcccagcctccgcagtacccgaacctggttctcccggtcccccggctcagcggtacagcgggcgtagccgacgaccgacgacatgatcacgccgggatgagcggagtggtcgcgacgtctgcgcccgcctacccctgcggccggcccaggcggcgggccgcgttgaccaggccgaccaggctgaacgcctgcggggtgttgcccaggtggcggccgctgcccgggtcgtactcctcggcgagcatcccgacgtcgttgcgcaacgacaggagccgctcgaacagctcggtcgcctcgacggtgcggccgatcccgtgcaacgcctcgaccagccagaacgtgcacgccaggaaggcgccctcggtgccgggcaggccgtccaccccgtcctggtcggggcggtagcgcagcacgaacccgtcgtggcacaggtccttcatgaccgcttccacggtgccgatcacgcgcgggtcgtcgtacggcagaaaaccgacctggggaatcagcaacagtgccgcatcgagccccgccgacccgtagtactgggtgaacgtaccgcgggacgggtcgaaaccgcggtcgcacacctcggcgtggatcgcgtcgcggatggcccgccagcggtccgccgggcccggaaggccgtgcttctcgaccgcggtgatcgcccggtcgaggccggcccaggccatcaccttggagtgcacgaaatgccggcgcggtcccctgacctcccacaacccgttgtccgggtgctgccagttgctctccaggaagtcgagcagcgagcgctgcacgtcccaggcgtcgtccttgaccgccagcccggactcgcggctcaggtgcagcccgtcgaggacctcgccccagacatcgagctggaactgcccggccgccgcgttgccgatccggaccgggccggcgccctgatatccggacagccagtccagcgtgtactcgggcagccggcgggtgccgtcgagcccgtacatgatctgcaggtcggcgggatcgccggcgaccgcgcgcagcagccactcgcgccacgctcgggcctcgctgacgtgcccggcgccgagcagcgcctgcagcgtgaacgtggcatcgcgcagccagcagtagcgatagtcccagttgcgcgggccgccgagttgttccggcagcgaggtggtcgccgccgcgacgatcccgcccgtgggggcgtaggtgagagctttcagaaacatcaggctgcggcgtacggcgtccgcgtacggcccgtcgtagtcgtggcgcccgagccactcctgccagaaccgccgggtgtcccgcagcgcggcgtccggttcggcgctctgcggcgccggctcgtgcgacgggcggtaggtgagcacgaacggcacccgctcgccggccgtcacggtgaactcggcggtcgtggtcaggtcgtggttgtgcagcggcaccggggtggtcagccagaccgcgtccggcccggcgaccgcgtgccacccgtgccgggtccgtcgcaccagcggcacgatgtgcccgtagtcgaagcgcagggtcaggtcgacgcgcatccgcaccgagccgctgaccccctcgaccacccggaccaggtcggcggcctcgccgcgcggcggcatgaagtcggtgacccgcacggtgccgtccggggtgtcccattcggtctccagcaccagcgtgtcgtcgtcgtaccgccgccgggtggcgacgcccgccccggccggcgcgatccgccagcggccggcaccctcgtcgccgagcagcgcggcgaagcaggccggcgagtcgaagcggggcaggcacagccagtcgaccgacccgtcccggccgatcagcgccgcggtgtgcaggtcaccgacgatcgcgtagtcctcgatccgcattgccatgctgcccgtccttcagttcgtgccggacatcggcggggccgggtcgccgcgggtcaccgtgtcgtcgatccgggccacgtggtgcgctccgtcggcatcccacctgtcctgctcagcgccagcctctgttccccgctcttcttgtcgccaaccaccattgcgttatgcaatgttctcgcctaccgcgtcgcccggggtccagcccagccaccagtccgggccgctcgggccggcagcctgcgctccgaccgcgggcggctttccggccgcagaccgctccgtcgccgcggcctgctcccccgccgctgtcgcgaacgcggtcagcgcctcgatcaccggcggcgaccacagccccgggttcccgtcgacgagccgctccagctcgcgacggcgccggtccaggatctgctcgaccagccgctgcccgtccggggtcagccgtagccgcaccacccgccggtcggtggccgaccgggtccggcgcaccaggcccttgccgatcagccggtccagcatccgggtcccggtcgacgggttcaccccgagctcctcggcgatgtcgatgctgcgctgcgggccccgtgcggccagcaccaccagcgttcggaactgcggcagcgtcacctcgcccggcaccgccgccagcgcccgcacggtgatcccgacgaacgcccggctggccagcatcagcgcctgcaccgcggcgcccggcgccgcatcggaagaaggttgcacactgccatggttgcatcatcggacccattccggccgcgacattctcggcgcgaaacggccgcagggtggacgtgaccggccaccaagttccggtcacgccgcggggatggccgcggcccggatcaccggccggtggtcagccggatcgtgaaaccgtcggtgtcgcggtagagggcgacgtggtcgcaggactggtgggcgatccacaggcccaggccgccgtcgacgccgtcgccggtcggcagcagaccggcgaacggctccttcgggccggagccggcgtcggtcacgctgaccacgagccggccgggcccgcaccacagccgcatccggaccggggggcggccgtgccggtacgcgttggacaccgcctcgctgaccgagacgacgaggtcctccagctcgtccggcccgaccacgccggtgccggccgcgcggaccgcctgccgggcctccccgggggtgggcgatgacaggtcggcggccggcgcgtcgcactgcagcgggtccggcggcggcacccggcggtcgctgagatagagcatcggctcggtgtagtcggcgttcggcacgtggccgccgtgcggggccgcggtgcgcgggtgggtgcgcagcacgtcggcgagcaccggcgccggggtgacccgcaggtcgtaggcgcacatgctccacagcgggaagtcgtcgtacgcgtggttgatcgccgactcgtaccgcgcccaggagtcccagagcggcccgaaggtgtccggcgacagctcgccgatgatccggatctgggtcgcgccggcggcgacgtgcccggtcaacaggttccggtaggcgcggatcgcggaggccggccgcgcgtacatcgccccaccggccaggacggtgaccggtgtgccggccggcagcgcggaccgcaccagctcaccggtgcgctcaccgagcgcgatcatcgtgggctcgccggccgcgatcccgccgagcaggaacggcacgaccaccgcgagcagctcgtcgtcggccgcgtagcagagcgcctcgtggtagtagccgtggtgtccggccgccgctccggtcctggtcatgcggccggctccacgcgcacgtgggtgaggccgatcagctcggccagccgcgccgcggcctcgaaccgggtgcgcagcaccgcggtcagcccgcgcgactcggcgtagcgctgcagcaccagcagcgcccgatggtcgatgaaccgcagcccggcggcgtccaccacgatctccccaccggccggcgccaggtcggtgcgtcgcagcgcggtggcgaacagctcctcgccggccgggtcgagctccccgtcgagcaccgcctccgcgcgggacagcgccggatgcagctggaacggcacgcccgccccggtgctcgactcgtgcaggcaggcgatctcggcgaccgccgcggcgcccagcacccgccggtcgtaggcgcacaccgcccgcatcgcgtcggtccgcatgtagcgcccgatcaggtattcatagcgggcgaaggcgtcgcgctgctcgtcgccgcggaccagctcggtgacgtcggcgaccacgcacagcccggtgaacccgtcggccagcgcctcctcggtcgccgccgcgtaggcgcccacctgggcgaccggatcgaggacggcctggcccgaatacgcatcgccgaagtgcaccacccggaccgcgtcaccgcccggcagcgcctgcgcggtcagctcggactcccggcccgggacgtaccagacccgttcgccgccggcgatcccggcgaggatcacctcccgcgcgtacgcgtcgatcacccgctgatcgtcgtacgaccaacactcgtgcccggcgcgctccaccccgcaaccatagtcgcacccgcccccaccagcgacgtccgcaccagaccgcccgccgggcagcggtcagggcccgtcggggccggccgggcccgcggtgtgaccgggggcgatagacgcctgcacgaccagggcggcagcgccgatgccggcggcgtcgcgcggctgggcggagagttccacgacgacgtcgtggcggtagcgggcgtgcgcggtcgccgccaggtggctgcgcaggcggcgggcgtagatcgagccggcgatcgccatccccgggccggtcagcacgatccggcccaggtcgagcaggttggccatcgaggtgaccgcgacgctcaggtagccggccgcccggtcgaccacggcgaacgcgtccgggtcgccgctgaccgcggcgtgcgcgatcgcgtcgtacgcgctgaacatgctcttctggtcgacggcgaggccggcgtcgcgggcggcctcgacggtggcggccatcgaggcgtagcgttcgacgcaaccgcggttgccgcacgggcacggccgcccgtcgtaggcgatggacaggtgcccgagctcgcccgcgtcgaagctggtcccgcggaacagcgcgccgccgaaaaccagcccggcaccgaccccggcggacaggtagacactgccgaacgcctgctcccgggacacccgccgggtccagaactcgcccagggcggcggcggccgcatcgttctccaccagcaccgggatgccgagccgggcggcgagggcgcgacgggcggcggcccactccggagggttgtcccggtggctgggcggggcggcggccgcgacgacggccaggccctcgatccggtcgcggggcaggtcgaggtccacgatgaagtcgtcgaagcgtgcggcgagctggtcggccagcccggtgtcgtcgagcgggaccacctcacggccgacgacgccgccggtcaggtcgatggccacgcaggtgaccgtgtcggggccgagctggaagccgatcccgaaccgcgtggcgggggtgatggcgagcagtttgcggggtttgccgcgtaccgagtcctctgatcccgtctcgtggatcaccccgtcggcgatcaggtcgcggacgatgttggagatcgacggctgggtgaggccggtgcgttcggcgagctccacccggctgatcgagaccgccgagcggaccacgtccacgatcagggcgcggctgcccggccccgccgccggcgtttcccgacgcgccatgtcgcctgacctccatgttcgagctgccgcagtgtcaggcgataccgtacctgtcgggtcggagggtacggaggaatcggtggcacagtcgcagcggcgggtcgggctcgttctggcgcgggcctcacgggtgctcggcgaggagccgtattaccacgagttcatcgagggccttgagcgggtgctcaccccggacggggtctcggtgctggtcaaggtggtcaccgaccgggcggcggagaacgcgacgtatcagcggtgggccgccgggcagcgggtcgccggggtgatcctggtcgacctgcagcccgacgacgagcgggtcaccctggtgcgggagctggggttgcccgcggtggtgctgggcgcgccgtcgaccgcgtcggggatgccgacggtgtggacggacgacgccgggtacgcacgggaggcgatccggttcctggtcgacggcgggcacgcgacgatcgggcacgtcagcggtcccctgtcgttcgcgcacagccagctgcggcgggagggcgcgcaggccgaggccgccgagctcggcgtgacggtggtgccggccgagggcgactactcgtacgagtcgggccgcgccgccaccgccgccctgctcgacgcccgggccaccgcgatcgtctgcgacaacgacctgatggccctggccgccctggacacgctacgcgagcgggagatcgccgtgccggccgacatgtcggtggtggcctgggacgattcggcgttgtgccagctggcgacgccggcgctgtcggcgatgagccatgacgtggtgcgggtcggggagatcgccgcgcgggcgatgctggatgcgatggccgggaaacctcctgcggtctaccaggcgccgctggcgcacatggtggttcgggagagcaccaactgacttaataaattattaatctaaggttgacatgcccgcaacagcggtcgcatgctcagcgccatgaccatcccccgtcccgtctgggcggtcggctccgtgctggccctcgccgccgccctgatgatccacaacgcccccgacgcctcggcgttcgccgccaccccgaagtccgccgtgatcaactacctgaagtcgatcaccggcacctcgatcgtctccggtcaacacaacaaggagccggccaacctgcccggccagtacacccagcaggtccacgacgtcaccggccagtggccgggcctgtggggcggcgacatgatgttcaccgccaccgacatcgccaaccggcagagcgtgatcaaccaggcgaagaccgagtgggccaacggctcgctggtcgcgctcacctggcacgcctgctcccccacggtcggcgcgacctgcaacttcgacggcggtgtcaagaccggcatcaccgacgcccagttccagcagatcgtcacgcccggcaccacgctgtacaacacctggcgcagccggatggccgccgtcgtcccctacctcaagcagctcaaggacgccggcgtgccggtgctctggcggccgttccacgagatgaacgagtcgtggaactggtggggccaccgctccggcgccaacggcagcctcaagctctaccagcagatgcggcagtacttcgacagccagggcctggacaacctgatctgggtctggaacgtgcaggacaacccggccggcgggtgggccggcttctaccccggcagctcgtacgtcgacgtcgtcaccctcgacgcctggtacaagaactacccgtcggcggcggactactcgcagatccagtcgatcgcggccggcaaaccgatcgcgatcgccgagatgggcaaggtgcccaccgccgcgctgctcgacagccagccgaagtggacctacttcatgatctggtccgagcagctgcgcggcaacaacaccaacgccgagatccagacctcctacttcctgccgcgcgtgctcaaccagggcgaggtcaaaatctcttgagacgattgacggtgtacgcggtgaccgccctgtccctggccctgacgaccgccgcgccggccgccgccggcccgggtacctgcccccggccgggcgggcagaccatgacggtcggctacggcggccgggagtatccggtcaccgtgtacgtccccgccggggaccggccggccacccgccggccgatcgtcctcaacctgcacggctcgcagagcaccggcggcgaccagctgcactacagcgacatggcggcggccgccgacgcgggcggctacctggtcgtggcacccaccgcggcgatccctgccggggacggcttctcctggaacgtacccggggtcggcagcccgccgcccggggcccgggacgacgtcggcttcctcgaccgggtgatcaccacggcggtgcgcgcgctctgcggcgacccggcccgggtgtacggcaccggctactccggcggcggccggatgctgtccgcgtacgcctgccggcgcgccgaccggctggccgcgatcgccccggtcgccggcctgcgcgccggccgcccggacccgcaggacagcacccggccggacccggcgtcgtgtgagccgtcccgcccggtcccggtaatcaccttccacggcctgcaggacgccaccaacccgtacgccggtggcggctccccgtactggggttacccggtgcccctcgcccagcagcggtgggcccggctcaacggctgccgcggcgcggccaccgagtcggcggtgagcccgcacgtcacccgcaccgcgtaccgccactgccgcaccggcgccgaggtcaccctctacacgatcgcggacggcggccacacctggccgggcaccccgatcgacaacggcaacggcacggtcacccacgagatcagcgccaacgccctgatgtggcagttcttccagcaccaccggctctgacgatccggtcccgccggcaccccttcgccgagccgggaggggtgccggtggggcggtgtcggtcttcttgccaggacctgcccgaccgccgcgggccgtcctcgacccggcatccgcgtggccggcgggcggcggtcaacagcgcaggtcgtccgcgaagaggaccatcgtggcgccgagcacgccaccacccacgacgaccggagcggtcaggcagacggtcaccgccagggcgaccctcgacacgactcgcagcgagccggtgccggcccgatagcgggcgagtccgaaggatgccacgcccaggcacagcaacgacggcacgatcaggatcaggaaggccacggcgaccacatagatccatgtcgaccggcagtgcggtgtgacgtccaggtacgaccacgccgacagcgcgccgacagccggagcgaccaaagccatgaccatcgagccgatggcgaggacccacgggccgacgggttcatgggcttgctggaccggtcggtatgtcatccccggctccgaggcatccgcgggccgaacctcgccgcgttccgacagcactcacaggtgacgatccttggcatgggtcccatcatgaggggcccgcgccaccggtggaggggcagggttcactcgcgcggccatcacgcgtgtcagcttctgtcgcgcggccagatcgccaccgcgatgaggacggccgcccagataccgagcggcgcgaccggccagtaccgctggagctggccgtcacggaggcactgcgtgccccagacagcgttcatgatcaacgcgccgcccagccagtaccgccactcggtcagccattcgctgcggtcacggcgtcgctgctcggcctgcgcctgtcgggccgggaccggcacatccgcggtcagcggaaccagctcgccgaccgtggtggccccggcggcgaccaccgtgcgccgatcgaactcggccagatcgatccgcccctcggcgagggctgcggtcaggcgctcgatggttgccgcccggtcgctgtcggcggcgcgcgtgtcgtcgtggctcatcccgacctcctttaagatacgactgtatccgaaaggaggaagatgccgaaagtcgtggaccgggacgcgcagcgccgggcgatcggcgccgccctgctgaccgtcgtggccgagcacggactggaagaggtcagcgtccgcacggtggccgcccgggcgggccgctcacccggtgccgttcagaagtacttccgatccaaggaggagatgctcctgctggccctcgacatcgccggcgagaaggctgagcagcgattgcgggccgtcgaccggtccggcacacctcgccaggtgctccaccgcctggtcgtcgcgacgctcccgctcgaccccgagcgccgggcggaggcgatcgtgtgggcagcattcgccgcaatggccgtccgccatccaccgttcgccgaagtgctccgcgagatcgaccgggcggtcagcgccgacctggtccgctggctcgaggccggccgcgccgacggcaccgtcgccctgcgcggcgatccgcgccggaccgcggacgctgtggtggccctctccgacggcatcgcggcccggctgatctaccaccccgaagccgccgacgaactcctcgcggcgctcgacaccgccctggacgcactgctctcaccgccgaaaccaccccaacccggcgatacggctcaaaccacataacccccaaactacgttgatcagacgtcctctcgaggcgatcaccacaaactgaacaacgagaggggcccgaaccgcgtttccgcagatcaggccttcaccgaaggagtgcgcccgaataggatcgagccccctaaccttcttatccgtagccgcgctccaggccgactcgactaggggaactcagatcttcggccaaggttctaaccctggacttgtgtatagacatctaagcggccgattagcacaaacagctagttgcagcgcatcctcgaaggtatcccctaagccccaaatccagcccatcccagtcgccacaaccatgccaccagattcaacaaatacgctggaatggctgagccattcacctatggggtagaaatttccgcccagaatactctccacctcgctagccagggaccgttgaccgaatcccccagcagctggatcgaagtttagaggatcatcattggaaaagttgggtccgtcctctcgtacgggcgcgatcgagagtccgccgaagctgcgaagaacttcgagcgcaagcccatgtgcatcaaaaccgtcaagtttaagctgctcaacccagtgggcaatatcaacatcacgttcggtactccagccagagacttcgaggaccgaaagcaactccgagtcaaatctatcgaacttgatcacgcatctcacgaccaaggtgtgtctagcgcctgcaatacctttcggcagcgaccacacggtgaagccggctcaccatgaccctcaacattagagttcggcatttcgtcgttctcggtcatcagagttcgcatcctaccgccgacgacaccgctagatctcgtcgatctcctcgttcgcgggtggacggggcccgaggcgccggtcagacccggaaggcctgcaccagggctcgcaaatcggccgacatcgtcgacaactcggtggtggcctgctgggtccgcgacacaccctcgctcgtccgctccgccgcgtcggccaccccggtgatgccggcggcgatgtcgccggtcccgttggcggcgtcgccgacgctgcgattcatctcggccgtcgtggccgtctgctcctccacggctgaggcgatggtggtctggaagtcgctgatccgggccacgacccggctgatctcctcgatcgcgttcaccgagctgccggtgtcggcctggatcgtcgcgatgcgcgcggcgatgtcctcggtggcccgggcggtctcctgggcgaggtccttgacctccgaggcgaccaccgcgaagcccttgcccatctcgccggcgcgggccgcctcgatggtggcgttgagcgccagcaggttggtctgttcggcgatcgccgtgatcaccttgacgacgttgccgatctcgatcgacgactcgccgagcttccgcatgctcgccgacgccccggcggccagcgcgacggcttccccggcgacccgtgccgcctcggcggcgttctgcgagatctccccgatcgaggcgcccatctgctcgccacccgccgagacggcttccacgctgcgcgagatctcctccgccgcggtggacacctcctgcgcccgggtggtcgtcatctgcgcggaggccgccatctgcgccgccgtgccggtcatctcttccgaggctccggccagggccgccgcggatcccgcaatggtggtcaccgtgccgcgcagcgcgccgacggcggtgtccatcgcctgccccatggcgccgatctcgtcgtgggtggtcaagccactggtgcgggtgaggtccttggcggcgagcgcctcgcagacccgcttgacccggttcagcgatcccacgatgcgacgagtcaccagaacacccagggtcagcgccagcagcaggccgacactgagcacgaggagactcaccgtgcggttgtgcgagtactcggtgtccgcggcggccgagccggcccgggcggccgcggtctcggcgtcccgcagcaccgccaggtcggcgttgagcttttcgaccaccggtgtgacggaggcgtcgcgaacccgcgaccacgcgcccaggtcgttgctgtcgcccagagcctgcaacttgccgccggcgatcgcggtgtacgcactccaccgctgggcaaggtcgtcgatggtggcggccgaggcggccggcgccgtacgccggtaggcgctgagcgtgtcgccgaagcgggtcaggtcgctctcgaaggcttgggtgaagtactgcgaggcggactcggtgggcgacagcgcggcgttcgccgagtcggcctgcgcttgggcggcggcgctcatgagctcgccgaccgccttgatgccgccgacgttcttcgtagagatcgccctcgccgcgtcactggtgttgcgcagcccggccaggccggtgatgccgacggtcagcgcgacggctccggccaggccgacggcgctgaggattcgtacgccgacaccgaggtcggccggcgagcgccaccgcgcccgctctccggtcaggggcccagcatccacggtgtggctccttgcttcgcggtcaatgtcagacctatcggcacccgggcgcagccggtgagtgtctgccggacatcggtggggatcggtgtcggaggtcacccgggcaccgtccggctcgtaccgcggtgacctgcggcggatcgtcggcgagcggccggtatcgctgcctcgaccggatcaagcaatggcaaaccgtggcagcccgctacgcgaagcgcgcagcccgccaccactcagcagtgctgctcatcgccgccccgatccggccggcgtgcacctcggggaaagccatgcacccgtcaggatgcttcggaggccgggcggcgggcctgcttggcgaggtacatcgcctcgtcggcggcggcgagcagatcgttcgggtccatcgacaggccgccggcgacgcccacgctggcgccgaccggggtgccgtcggtggcgctgagttcaccgagccgacgctcgatccgctccgccagggcacgggccacctccagctgcgtgtccggcagcagcaccacgaactcgtcgcccgcgagccggcacgccaggtcgcggctgccccggcgcttggcggtgcgcaatgtgtcggcgacctggaccagcacgtcgtcgccggccgcgtgccccagccggtcgttgatctgcttgaagccgttgaggtcgaggaagagcaccgccaccggctccgggccggcacagcgtcgccggagctcggcggtgaagacggcgcggttaggcaggccggtcagcgggtcgtggtgcgccagctgctccagccgtcgctgcaggcggcgggcacgatcggtgcgccacgccagcgtctcgccgaccagcaggtagatcggcagcgcgtacccgatggaggccagatccgaggccgaggcgccgtccaggatcagcggcaacaggtaggcgacgatcaggaacggactggtcttgagcgtcatcccccggcgttcgcacatgccgtaccagaggatcaccatgagatagaaatagccgtaccggaacggatccagcccggaggcgatgttgtagaggccggtgaggcccatcccgagggggccgaccgcaagccgcatgccgtcggagatccgctcccagggcaggggcatgaacaccacgccgaacgccaccgccacgagggcgaccatgacggtgttcccgcgcccggcgtcgggctgggccggcagcagcgtcatggccagcgcgtacagaccgcagctggcgaacagggcaccgatggtcacgccgctggtcaccctgagatcgccggaacgcgcgttggtccggacgcggtgcatgtaccacttgcccacggcattcatatcggcgctctggccgattccgatgagccgcacgcccatcccgcgatgtcggcggccgcgggcgccggccgtgttcgccccactggcgccgacggctttccttctcgtgcgcacaggacggcgccgacctgcgaagtcacgctgcccacctactccacggccaacccgccgaactggtcagcgacgttctggtcccccggttcagcgatggaggtaagcggccaggccgccgagttcctcgttggctacgaataccgaccgtacggtgatgagggcctcctcgacgtgcgcggtgcagccccacgcggagtcaccccaggagtcagcgatcttgaggtccgccggtgcggtgcacccgccggtcccgccgagctgacagtgctccgggcggggcagcgtggcctgcgccgtgacggcgacacgcatctgcgcggccagttccgcggcggcggcggcgcgccggtcggcctcggcccgcagttgccgttccgcacgagccgtagcgtcgagtcgggccgcctgtgcacggctgcggtccaactcctgccgcagtttgatctgcgcgctggccgcctccgccagggtgtgcaaggtttccacctgatggggttcccaggcccgccgctggtcgtcgacggcgcacagcccgccgatgacctgcccgtcgcggtcgcgcaccggcactccggcccaggcgccgatgccgagctgctccaccgcgggcacgtcgcggatccgtgggtcccgacgggcgtcatcgctgatcagctcccggttggtggcgatcaggagatggcagggactctcatgcacgaggttctgccgctgctccaccagcaggtcggggccgccgatgcagctcttccagaacgagcgccggtcgtcgacgacggtcacgaatgctcgcccggcgccggtgacctgcacggccagccgggtcaacgcgtcgaactcctcctccggcccggtgtcgagcaggcccgtggagcgcacggcagccagccgcgccgggtcgaacacggcgggaggaagtccgtgggggttcatcggcgccgccagcccgtccgccggacgcggcgtgggcggctgcgcgctggtattcgtgtccacggtcatgatcacgactgtaagccacctctcttcagatcgccgggagtggccgcgacgttgccgaaccgccacgcccacgggtatcgggggctcaggtcgagagcccgctggccctgccggcggacgcggctccgattcactcccgtgccggaaagcacgacatgaagggcacggacggctggacgtcatgagcgccgtgtcgtgacagtgtcccgcgttgccggcgaccgactgttgcacgcgttgagcatgatcactgggtgctattgatgctgatcgcgctcgggccgatcctgttgctctggcttctcatgtcccgcgcgccgcggacgcggtggatcatcgccgcgggcctcgccggtcaagccgcgacggcgtgcctgctcttccacgtctttccccgcggcgtcctcgagatctctctgtcggtcctggtgctgagcgtggcgaccgctgtcaccggccgtctcgtcgaacggcgccggctcggccccgcgaagcagacccgggtgggggtggcgacgcacctcctggccgggtggtcgttgctggcgctgctctgcggcggtggcatcgcgcggccggggccgttcttcccggagaccgatggcgtgctcccgttgcccgagggcctgcatgccaccgtccgtcccacccacgatgcggactgcggctcaggctcgtgcacccggacgatcacggtcaccggccgacccgggcaacgcggcgatgacctctatgacgagctgaaacggcacctcgagaagcgcgggtggggctcaggatgccgccccgtcggttggctgttggaccggagcaccgcgtgcgtcgagctgttcgtggccggcaacgaggtgaccatcgatctttccggcaaccggggcggccggtagcacgtcacgaccgtcggctgagccgatcacggcagcaggcgggactcctgcagcagcagcgcgtccagcgccttcggatcgttgggcggcagcgcgtacgtgtcgatcatgaccaccatgtcggcgcggaccaccaggccgctggagcggatccgcccgatcttgtccttcttcggctggacctgcgccgacgtgtcgtccgcgcccgccaccgggaccggctcgccgtaccccgcgaaccgcagcgaggcctgctggaagtcggcgaagtaccgggcgttgccggtgccctcgaactggaacgcgcgcacgtcgacgatcagggaccggccgtcgatccaccggcgggcgaagccgcgccggaactcgtagcggtcgagcaccgcctggaacgcggccggcttcgcgaccagtttgctcatcgccgccgagtcggccagcgcctgatcggcgggcgcggtcggccacttgcgcgagcccttcggcgccgggatcaggtactgcgccaggtcgcccggatgggtcgggcccggcgccggctccgggtcatcctccgcacccggcgacaccgtcggctcaccgaccgccacggtgcgcttcggctggtggtcgcgcacggtgtaggccacggcaccgatcccgccgcagaccacgagcagcatcgccaccacggccgagccgatgatccacgccgtccggctcgaccggcgcggcgggtgcgcaacggcgtacgacggcaatcccggcggccaggaaccgggcggacccggcgggaaggccgcagccggatgcgccggatacatggccggcgggccggaccagacgggtgcggcggaggacggctcgccgtcgtgggggttcgatgacacggcgccagtttgatgatcatcatcgggcggcgcaacccggatgtccgcccggccggcccgcgcgacgattcccgggactcctatatccggccaccgcggcacgcccctcccctgtgcgaccggaagtcggatggcccaaccggccgccgcgatgcggcgaccgatccggcaaatggcgccgcccgaacccacatgtcatcagagatccatcgacgaaccggcacgttccatcaagggccaccgcgatccgagagccgcatcgtcgacgaggcagagcaagcagtagcgccgtgcagggacatggagacatcggtgcacacaccgacctcaagcaggccggcgacgatgccggacctgtcagaaacccgtcggagaatcgacgtcttcgaatcccggcccactcgtcggcgaaccgtacagtcaaccctgtgacggacatcggaagccgcaacggtgaccggccctgcgagataatccggggaaagaccatcgccgcccggcagatacacgcctcgcaggagttcgccgtcgaacgaatagcagccaccccctccccggagtgacccccgacaccgtatgcgccatcacaacgtcaaggcggcctgatctacagcgctgcacttctccagtaaggcagggcttggccgatggcgacccctccacgcagcaaggctgatcaacggttcgagttgtttctcatcctgctgctgtggctgttcgtcggctacctgtacctcttcgtcggtcccggaacgttcttcaccaacctggttgacggaggcgggggtgaccaagggggtaatggcaatgtccaagaggatgttcagcgccgaagagccgcagccgaagcggcgttgtcccaaggaaccgcgagcgctgaataccgtaaagcggtcaaagtcggcgaaacggttgaggtgcggttgacgatctgcggagccgcggcgaaggactgcaaagacagcccctccgctacatctcatgaccccgaccatgccgtcgtgatcgcaccgaccaagaccggcggcaacatcgaggtcacattggtttcgcctgacaaggaaggtctgccggaggacctcagcggtaacgggacgaagtttgtgccggccaacggcaccaaacgttgggcttggtcgcttaaagcagagcgtccaggcacctacaaactcaccgcgcgggtcatcatccattggggtgagaccgaggcggagttggacaccactgaggtgcctcccataacggtcgaggtcgaggacactttcagtgcttggacggctcgatgggccaaacgcgctggtgacttcatgaacagcgtgggaggcgcgttggccgcccagttcgccgcagtcgtcggcttcctggtgtaccgccacagcaagcggaacacgccggccaccgcggcggcacaggccctacccacggtcccgccgcggcccgccccatcgacggcgcaaccgcagccgcagccgatggcgccaagagcatccggcgccacacgccggtcgccccctaaaccacggcagcccgttgcgacgacttcccccgacagagtccgcaaaaggtagggagcgcgccggtctacgtcgacatcctgcacgccgtcttcggcgggcggtgatcctccatccaggacgtggcgaagtcgaccacgtcccgctgcggcatcaggcgcgcaacggcactgcccaccggcccgaccgcgatggcgcccaccgcctcgtacgccgcgccgatcaccgggaaatccgaggcgtcggtgaccggcgccgtccaggtgacccagcggctgccgccctccccgtcagccaccgcggccccgtaatccatcatcggcgcctgcggccggcgactctccgccagatgcaacgaggtgttccgatcgtgtccgcatcccagcagcagcaccttgccgtgcgcccggtagagcgcgccgaccggcgagttctcccccagcggctggtcgagccggtgcccgccgacgatggcccgtgcccggtcaccgaccgcggcgaacgacaccgacggatggccgctgcgcaccgcccccggccaggtccgcaccgtctcggccagcacacccatgtgctggctgggcgtgcaccgcgggtcgaagcccggactctgctcgcggatcaccggccaccaccgcggcggcaccggcggattgcgccacccggcgggatccgagttgaacggcgtgtgcgtcggcaccgccagtgtgccgcccggtcccaccacctcgagcagggcccggacgaccgcctgcacccggccggccacgaacccgagggaccgcgtcgacgcatgcaccagcacggtgtcaccagtcgacagccccagatcccggaggtcggcggccaggcttcccacggtgtgcggcatcggctgggtctccgcggtcatggtgtccgcccgatcgcgtcgtcgccgtccgcgtgcacccgcagcgacccgccgtcgcggctgacccacggatcggtccacgactccccggcggcgggcacgagcagccgggccgaggcatgcccggcgtcgtacagcagcagcgatctgatccggcgacccaggccgcccatctcccattcctgcgccggatggtcgtccggcccggcggcctgcaccgtgtagaaccggtcgtcgacccatcgcccgacgctgtccaggacgatcccgtcgccgaccggctgcccgtccacccacagccggccggcgttcgcccggtcccaccagaggaccgcccggtgccggccggccgggctgaagtcgatccacacgtgcccggtgccgtgttccaggtaataggcgtgacagggccggtcccgggcgcagaccgccggctgccggcaggggcggtcgatccgctgcgcgcagccgaagccggccgccgcgcagtcccgcgggaccgcccgggacagcacttcgatcagctggtcgcggtacgcgtcgtcgcccagcaggtgccggtattcgtcagcctcctgtcgccgggtgtacaactccagagccgtcgccgaaccccgcagccaggacttccactgttcgtccacgccccgccaccggcgggcgccacgcacctcgagctcctccggcggctgccgcagcgcgcgcacgatccgctcctcgcgggtcttctcaccgcgtcccaccgctcccccgatcatcggttttgtggcgtgttgtacggtccacgcggcaactgtggatgaacgtgagagttcagccagattcagggcgtaagcgtagtgaccaatggtaggagcaactgatgccgcggccgagtgactggtgggtactcgaccttgatgcggacccgactcccggcgagccggcgaatctggtcacgacgggtaatcggctgctggacttcgccgacgacgcgcaccgcgcacagcgggcggtggattcgctgcagggcgacggtgcggtgctgacctggatcggccagtccggcgacgcgttccgtgagcagttcggcgagctccccgcgcagctgcgcaaggtgtacgactcgcaccggatggccggcgacgcgctgcacgccttcgcgcccagactggaggccgcccaggccatggccgaccgggcgctggccgacgggcgcgcggcccgcgagcagctgaccgggttgaccgggcagctccagctcgcgcagggcgacgtgacggcgatcgggcagcaggcgacggcgttgcagcagcacaccgaccccgatccggagcaggtcaagcaggcgatccgcgactccgaggcggccaagcaacggctggccgacgtgcagggccgggtggccagcggacagcaggcgctcaacgcggcgaagtcgctcgccgagcaggcccgccagctgcgcgacggcgccgctcaggagtgcaagcgggagatcgccgcggcctccgacgccgggatccagccgcggtcgttctggcagaaactgggcgagttcctcaaggggctgtgggacgtcgtctgcgaggtcgccaagtgggtggccctggtggccggcatcatcgcgatgatcatcggcggcccgctggcctggatcgccctggccgccggggcggtgctactggtcaaggcgatagtcgacttcgcccaaggcaagggcagcatcaccgatctgctcttcgcggtcctcgggatcatccccggggtccgcgggctgacctcgctctcccggctgtccgcgctctacaaggccggcggtctcaaggcgatcgcccaggcggcactgacctcgatgaagaacaccgtgcgcggcctggccaccacggtcaccaccgcggcccgcggggtggtcgacgtggtcaagacggggttcagcaaactgaccggcaagatcaacaagattccggtcaccacttcgaagcgtacgttcgagatccccgcctgcggcgacccggtcgacgtcagcaccggccgggtgttcctgccggagaccgatctcgatctacccggatcgccgccgttgctgctggagcgcacccaccgctcggactaccggtccggccggctgttcggggtgtcctgggcgtcgacactggaccagcggatcgtggtggagtccgacgcggtccacatgctggccgcggacgggacgctgctgacctatccggtgccgggtgccgaggggccggtggtgccgggccacggacgcagcctgccgctgcgccgctccggcgacggcttcctggtcaccgacccggcgaccggccggtccctgctgttcgccgcgccggtggcggatccggagccggacctggtcgccccgctgctcccgcgggaggtgctgccggaatcggccggcacggtcccgtcccggaccgcagagctggtcgcgatcgtcgaccgggagggcggccggatcgaggtgctccgggacggccggggcgctccggtggaggtgcggcacggcgacggccggcggatcgccgtcaccaccgaggacgggcagatcacggcgttgcacctggttccggccaccggcggtgagccggtgctgctgcgtaccttcggctacgcggacgggcacctggtcacggtggccggccccgcggggcagacgatgcggttcggctacgacggtgacggccggatgatccggtgggacgacagcaacggccagtggtacgcgtacacgtacgacgcggacgggcggtgcgtgctcggcgagggacgggacgggtacttcggctaccggttcgactacgacccggaccagcggcggaccagcgccaccgactcgctcgggcacaccacggtctaccagctcaacgaggacctgcaggtggtggcggagacggatccgctcggcaacaccacgcgcagtgagtgggacagccagcaccggttgctgtcccggaccgatccgctgggccgcaccacccggttcctctacgacgccgacggcggcctggaggcgctgctgcgccccgacggcagctcggccaaggtcgtacaccggggcgggcggatcgcggcggtcacggtgaccggggacgacgggcgactgtgccggcgtgactacgggcgggccgaggcaccggaccccaccgtcgatccgctcggcgccggcccgcggccggccgaacggcaccgggccgggacgacggccccggcccgggcgtcggacccggcctcgccccggatgctcgtcggcggcgccggaccggccgtatcggtcgaggctcgggacggcttcggccggatcagtgcactcggcgacacgaccggccggcgcatcgtgcagggctggaccgtcgacgggcagccggcctggcgggagaacgcggacggcgatcgccggcagtggcggtacgacgccgagggcaacgcgatcgcgcacaccgacgaactgggccgcaccacccgcaccgaatacgggccgttcgaccttccggtggcgaccgtgacaccgtccggcgcccgcaccacctacgactacgacaccgagctgcgactgatccgggtcacgaatccggccgggctgcagtggcactaccggtacgacccggcggggcgcctgatcgaggaggcggacttcgacggacgcctcagccggtacacccgcgatcccgccgggcagctgacccgcctggtcaacgcggccggggagagtttcgcattcgagtacgacgtgctcggcaacctgatccgccggacggccgtctcgccgaccgaaacccgtacgacgacgttccggtacgacgcggtgggacatctcgtcgaggcgatcggcccggacgctgtgctggagatcacccgcgacgccttcggccgggtcaccgccgagtcgatcaacgggcgggcgatcacgcacgcctacgacgacagcagccgcacggtgacccgggagaccccggccggcgtgggaacactgtggtccttcgatccggacgggttcccgatcggcatccgcatggctggacacgaggtggcgctcttccacgacgcgggtggccgccccgtcgccgaacggctcgacgagtcggtgaccgtggtccggcagttcgacgccggcgaccggctcgtccggcagcggctcagcgacggcgccggcgcggaggtggagcgcgcgttcggctaccgcgaggacgggtcgctgacgctcgtcgacgacagtcgcgagggcgtcacggtcttccgcctcgacgatgagggacgcgtcaccgccgtcgacgggccgggccgtcgtgaggactaccgctacgacgccgccggtgaggtggtcgaggcgtccgcttcggtcgccggagcgaccgttcccggcgaccggcgctatcagggcacccagctggttgaggcgggcgggatcgagtaccgctacgaccccgccggccgcctggtgcagcgccgggatcacgggcgggtctggaccttccggtgggacgccgacggccgcctgcacggcgtgatcacccccgacggcggccgttggcggtaccggtacgacccgctgggccggcggatcgccacgcagcgactgaccgacgggccggccgacgccccgctcgacggtcccgtgctgaaccagacggacttcgcctgggacgggccggtgctggtcgaggagtcggacgccaccggccgcaccgtcacctggcagcacgacctggacggatcgcggccgctggtgcaggtcgacggcgaccggctgcatctgctgatctgcgacccgaacggggcgccgaccgacctggtcgccgccgacggcaccgtgatccgcggctccgcgccgtcgctctggggtcaccacgccggggcggggacgccgctgcgtttccccggccagtacgccgacgccgagaccgggctgtactacaacctgcaccgctactacgacccccggaccggccgttacctgagcccggacccgctcgggctgagcgcgggacccagcccggtgcggtacgtcgacgatccgctgctgcagaacgacccgctgggcctgtcgccgcgctcctgcacgatcggcaaacggccccgctacgacgacgacgccccgaccgagctggacgatctgctcaacgacccggagatgctgctcgccggcagcgcgctgaagaaattcaagatcagcgccccgccgaagaccaagttccccacgccgccgggcaacctgctgatcggcgacatgaagacggcgctggcgaagtacgactccgacttcgccaacgcgtccctcgccaagttccacggcccgcaggaccagagcgcggtgctgtccgacgtcttcaacatcggctccaagaccccgaagctcgaaggctggtcggtggagtggctcaacaagttcgagcgcaccggcggcgtcagcgactacctcaagaacgccgacgtcgagaactcctgggtccgcgggcacctgctcaacgaggacttcgggttcaccgggcacacgcacaacttcgcgccgatgaccaccatgggcaacaacgccttcaagaacggcttcgagcagcgggtgaaggacgccttcgtccggatggaccagctgcaacggctccacccgcagaagttcgaccagctcggctcgacgttcaccgtcgacatcagggtgacgccgagccgggagggcctgttcgacggggtgcccggggtggacgtcgcggagctggcgatccccaagcacatcagggtggaagcgcagtacatgatcgacggcaagccgctgcccgacagcgtgctgaaggacctcaacagcaccatctggaaggaacgaccggtcaagccgctgccgtcgaacaacaccatgaacccggtgaccggcgagtgggacccgcccgtccccaccaaattctgagagacggagagaggtcgacggatggcttcgtccgatcagctgaaggtggacctgaccggcctggaggacctggccgggactctcgaccgcatccgggacggcctgaacagcaccggccgctggatcctgcagttcaccggcgacctcggcggcgacgacgtcgacgacgcgttggaggacttcgagtcgcactggagtgacggccgctcccgggtggagaagaactgcgagcggctcgccaagagcgccaagcaggcggtggagcacttccgcaaggccgacgacgagttgaccaaggaacttcaggaacaggtgaagagttgacagaccccaccggcttcgcgatcaccgtcccggactcctggttcgagatcgacgtgcaccccgacacccgcaacagcgcgatcagctcgctggtgaacgagcgggtccggtcggtgcccgagctcaacccgcaccgcagcgcgctgacccgggcgctgcgcggcgtggcgcggaccgctcacgccaacggcgccgcctactgcggggccatggtgcagggcttcgacgaggcgttgctgaccgcgagcgtcaccgtgaccatcgtgcgggcccccggcgaggaggtcgaggcgtcggcagtcgccgcccagctccgtccgctgccgcgctccggtgcggacgggccgtggcgtgaggtggtgcaggccgagctgcccgggatcggcggtgtcccgcggacccggggcgtcacggacgtcgtcctgcccgaaggcgaggggtggatccggtcggtcacgatgcagactttcgtgcccttccccggggtgcggtccgaccggatcgccgttatcaccggcagctcgccgatcctgccgctcgccgaggatctgctggacctcttcgacgcgatcaccagcactttccgattcatctcgccggactcctgaccgctcctcggtcgccggcccaccagcgggagcgaaggcttccgtcgtacgaaagggaaatgtcgtcatggcgaacgtcaatgtcacctatggggagatgcagaatgccgcgaaccggctcacccgcggcaaggacgaggtcctggacaagctgaacgagctccgccggatggtgaacgagctggtcaacggcggctacgtcaccgactcgtcgagcaagcagttcgagcagtcgtacgacgagttcaaccagggcgccaccaagatggccgacggcctggagggcatgggcaagtacctgaccgccgcggccgacgcgttcaagcaggccgacgaggagttggccaaggcgctcaagagctgagcggcacaccgcggcgcgggggccggccgggaccacccggccggcccccgccgtgtgtcagcgcggcacctgcaccacggtcggctcggcgtcacccaggtagagcagtgcccgtccgggctggaccggctgacccaccgcggtccggggcaggcgcaccccgaccaggtcgccgtcggtacggttctgcggcgacaacaacgcgccccggcgggacttgcgggcgtccaccagccagccgctgaaaccggcgctgagatcctcggggtcgccggcgtacacgatccccagcggccggggatcgccgccgcgcaggatggtccgcagctcggtggaggcggcgacatcgcgcagtgcctcggcgtcgtccaccgcgatcaacgcccggccggtcgtggcgtccagcgccgcggtgaacgccgcggcatccacgtcggggccggtgaacgccgcgaccacccccggccggccggccaggtcgcgcagcggcgaggtgcgcggcgccaggatgatcacctgctgtccggcgtccagggcggaccgggccatcgcgaccagcgcggtgctgcggccggacttcggcgggccacccaccgcgaacgccggcaccccctcggccaggtcgggaccgaacgcggtcaactggtcgccgccgacgccgaacaacagccagccggcacccgcctccgccgggcgcagggccgcgacctcggcgtacgcgatctgggccggcaactcgccgagccggaacggccgggccgcggccggtaccggggcgtcccgttcgcgtgtccggcgcccgatctcgaccaacgcggccgcctgcccgggcccgctcgcctcgccgggcagcagcgcgatctgggtctccacgccggatccggcccgcaacgcccggcccggcgccatccgctgcggcacgtcgcgcggcgagatcccggccagcgacatgtcaccgggatcgggcatgcgcaggacgatcttctcctcggtcagcgtggcgatccgcccggtcagcaccgagcggtcgccggcgacgataaggtgcacgccgcagctggcgccctcccgcaggaaccggaacaggatgtcggtcagcgcgccggcgtcgagttcgccgagtgaggacaggaagccctcccaactgtccagcagcagcacgatgtgcgccagcggtccgtccgcggtggccgccgcacgttgctcggtcaggttggcgaagccaccggcggccagcaccgcctgccggcgacggatctcctcgtccagccggcggatcaaccggaccgcccgctccacctggacccgggtgaccacggcgccgcagtgcggcagctcggccgcggccagcagcgcgccgtttccgcagtccagcccgtagaggtgcaggtcggcggtcgagtaggtgccggccagtgagccggcgatggtgcgcagaacctgcgaccgtccggtccgcggcgcacccgccaccaccaggtgaccgaaccgctccagctccaccacggcggtgtgcctggcctgctcggcgggcaggtcgtcgacgccgtagggggcacccgcgtccgcccgcagcgtctccacgccgaggctctccggcagcgccggcagccacggactgtgctgcggcgggatgccaccggcctcggcggccgcgctgatcgccgccaccagcacctgcaggtcggtgacgtcgtcccggtcgtcgcgacgctccaccggcccgtcctcgggaatgcggcccaggtcggcccagcccagcgggcgtaccgacgggtcgggcaggtcggccgagcgccggccggaccggcggccgccgacccgcgccgcctggaacggcacgagggaggcgtgcccgagccgcacgtacgcccggcccggtgtgctcttgctgatccgcgccgcgtccggggcgttgatcacatcctggctctccgaggtgtcggtgacccgcagggcgatccgcaggttcgtgttcgcccggatctccggggacaccacaccaccgggacgctgggtcgccagcagcagatggatgccgagcgagcggccccgctgcgcgatgttgaccagcccggtgacgaagtccggcaggtcacggaccatcgacgcgaactcgtcgatgacgatgagcagccggggcagcggggcgcggccgggatcacggtcggcggcccggacgtagtcgtcgatgtccttggcccccgccgcggccagcagatgctcacgccgccgcaactcggcgcccagcgactccagcgcccgccggaccagatgttcgtccaggtcggtgaccatgccgacggtgtgcgggaggcgtacgcagtcaccgaaggcactgccgcccttgtagtcgacgagcacgaacgtcatcgcgtccggccggttggcgacggccagcgacgccaccacggtctgcagcagctccgacttgcccgcgcccgtggtgccggcgatcaggccgtgcgggccgtcgcgccgcaggtcgatctcgaacgggccgtcgtaggactcgccgaccaccacggccgtgctgcggccacccatccgccagcgggccaggatggtgtccgcggccggcggctccagggccagcacctgcagcaggcggctggaggcgggcagcacggcgtcctcgtcgtcgtcgctgacgtcccgcagcggggccagcgcccgggccacccgggcacaccatccggggtcgaggaagtccgggcgcacgccggcgatctcgtcgctgccggcctgggtcacccgcaggccgccgccggtgacctcgaccaccgcctggcactcggccggcagcagccgccgatcgtcgtccaggcacagtgcgtggatgccgaccgccggaccggcgcgcagcaactgcaccaccccgggcagcgaccgcagccggcgcgaaccgtccagcaccaccagtacgtcgggctcgccggcgggcacctcacccgcctcggaccgcacgctggcccggtgcacacacatctccagcagttcggcgacccggcggctcaccgagtccgcgtcggtgccgatcagcacggccggcccggacgcacccggcggccgggcgtgcggcagccaccgcgcccagtcccagcactcccggccggtcggctcggtcagcaccaccacgtgcagatcgtcgggactgtgcaggaccgccgcctgcaccaccgcccagcggcccagcgcccgggcggtgccgtccgcacccgcgacgccgaccacaccgcactcgcggagcgggaccgtcaccggcacgtcgcccgaactccaccggctcgagcggcggtgctcctccagcgccagatcctcgacggtcacctcggacggctgaaccgcgctccccacgcgcagccgcaggtagtcggtgtcccgccggcgccgctcccacaggcggtgccgcgggccggtcgcgatgcccgcgacggcggccgggtcgggataccggtgccggcgttcccgccgctccagccggaccgcctcgcggatgtcggcttcgatgccggcccgccgggtgcggtgctcggccatctgctcggtgtacgaacgccggccgttgcgccggttcaccagatggttgccgagcatcgacagcgggctgagcagagccaggaagagcgtgctggtattgccggtgatcatcaccagcgcgagcgcggcggccaggggcagcagcgccatcagccacggcaaccgggatcgggaggcctcctggggcggcgcgggcagccggaatcgcgtctgccgcggcaccgggagaatccgtggtggacggttgtagtcgatcgtgacgtcgtcggcggacatctgcagggccgcgtccggcagcacgtagtcggcgagttcgaggatcgtcgagccgagcgtgacctgctcgccgggcgaccaccggacccgcgcctcgaccggctcccgctcgatctccaggatcgtcccggcgagcggctcgatccagcagtccccgctgaggtcgacggtcaggcgcgcggccacggtggccagcccggggtcgggcacggacacccagcagtcgtcgccggagcccacgtcgccggcgcccgcgccgagggggtgcgtcgcaccgatcgcggggccgccggtgacgcgtacctcgaggagtcccggaatctcggtgatcgagccgtcgaccggagcgtccaggccgacgacggctccctcccgcagtggcgactcggtcagggtgagagcgggatcgagcggccgaccgctcagatagagcgcaccggcggtgcggtcggcggcgtcgcgcatcagggtctgcagcacccgtgcgagatcaccgatccggttgccggcgtcggccgtcaccgcgacgtcggcgtgttcgctggttcgcggatcgactacagtcaggaaaaatcgcacagtgtctccgtatgggcggcacgaggtccactcgtgattccacagcagtcggtcaaggtggtcgcgagcgggcggtgatcgagagcattgcgacactcgcgtagtcttttcgcgtttgtccaatcgtctctggggatcgcatgcgaagccgagcgctaccgacaccgtccaccctgcccctgctgctggtcgccgccgtgctgggcctgaccggtgtggtcgccgcggaacagccggtccgtccgccggcccacccggtcgcatacgccgcccaggagtcggtgaagtactacgtcgtcaggaagtcgtacaagggcgagccggagttcctctacgagatcgccgaacggttcctcggcaacggcgaccgatatgccgagatcttccggctgaaccagggacgcctgcagcccgacggccgggccatgaccaagcccgaggaggtcggtgccggctggatcctgcaactgccggaggacgccaagggcaagggcatcgtcgtcggtccgctgcccgtcgtgagcgcccccgccgccgcgagcgccggtcccgccagctagctagctagaacgcggccggcggctccggatcccatctcggcccggtgctcggcctggtgggtggcggtctcctgctcgccggcgcggtcgcggccggcctgctgctgcgccggcgccgcgccgcgggtggcacggtggccggcgacaccgccccggcttccccgctgccccgggccggggcgatcccggcaccgtcggcacggctgaaacggaccccggctccggtgctggtcagccaggtggacgccgcagcgaactgggccgtggaccgggcgctgcgcgtcgtcgccacggcctgtcaccaggccggccgcccgctgccgctgttgtacgccgtgatgatcgacgccgagcggatggtgctgcgactggccgtgccggacgaccggccgcccgcgccgtggacggtgctggagaacggccgggcgtgggaggcaccgctgcgcgatctgcaggccgccccggtcgacctcgccgtaccggtgccgaccctgcacctggtgaccatcggtaccgcggaccggacccgggtgctgctcgacctgggccagtgccacggtctcatctcgctgaccggcgacaaggccgcgatccgcgctctcgcgctgatgtgggccaccgaactggccaccaactcctggtcggcggagagcggcgtgctgaccgtgggcctgggtgacgcgcccggcgatgcgggacggatccgggccgccgacggggtccgggctgccctcgacctggcctccgcctccggtacgccgagcgcgctcttcctggccgccccgccctccggccgggacgcggcggccctgcggacgctgatcgccagccccgagtcgggttccgccgcggtgatcctgggttcggtggcggacgcccggtggaccttcaccctgcagccggacgggcggttggacaccggcgcggtcggcatcgtggtgcacgcgccgctgaccaccgcccgaggctgaaatacggcggtcgccgggtggctcagttcgtgatttcgctgagggcggctcgtgcggcccgccgggcgacggcgatgacgacctcgtcgccgggatcggtggagggtgcggcctgaacggcggcattgatgctgagcaccgccatccgcagcaggagcacgttctgcggtgacgggtccggcagcagggtggtcagctcgtcgacgaagtggttcaggctcgccccgatgcggttgccgtcgggtccgctggtcagggtgcgggccagcagcgggttggcgctcatgaaccggatgccttgcagcttctcggcggtgaaggagtccacccagcgcaggaccgccgtggtgagcagcgccggggtgcggggctgctcacgcagccaggtcaccagctgctcggcctcgacaccgcgctcgtcgaacagcgactgcaggatcgcctccttgctgtcgaagtagtagtacagcgacgccttgttgatgccgagttcgtcggcgatctggcgcagcgacgtcgcctcgtagccctgttcggtgaacagacgaagggcgatccggcgcacgagcgcccgggtctccgctccgtcgcggcgtccggcggtgcgggtccggtgtggggtggccatgccacgagcttacctaacggccggttgacagtctacctaccgttaggtaggttcctgccgtcccggctgggatgcccgatcccgaggagattcgtgatgagcgagtacgccgtgatccgtgaatacccgttccccgtggcggaggtgtggcatgtcctcaccgatccggagcaggtcgcccagtggaccaccagcgggcagggcggacgccccgaggatttcgctcccgtaccgggcacgcggttccggttcgtcggcaagccgaccatgggctgggccggcatcgtccactgcgaagtgatctccgtgaccgcgccgcactccctgcactacacgtggcggggcgacgaagacgcgggtgatgtcaccgacgtgacgtatcagctccaagagatcaccgggggcacccggttcacctggcatcacacgggcttcaccggcgtcggcgggttcgcgatgtcgcggctgctcggctcggtccgcaagaagatgctgaccgagggcattccgccggtcctcgaggcgtatcaccggattcagcagcgcactaatcctgatacgtgatcacgatgcggccggatcgcaggaatttgtcgacctcgaagtcggtcagtttctccccgttgctcgcgcgccaggggaacatgccgacgagccgcttgacataccaccggtccagggtctcgtcgtggacggtcgtaccgctgggcaggtcggcggacttcacaatggcggtcacagcctcggctccttcactatccaaccgggaggtccgggcgcggagtcggctggcgtgcgcacccggggatcatgacgataacgattcaccgggcggctcttcgccggctatcgcccgacatcacccgctcgacggagccgtcatcgcggaaaggaaccgccggcgcgtggcacgcccatcgggttgggataggggacgaccgcggcaacggcgacggtcagcggcgtcaccaggtgcgccagccgactctgatcggccgggctgagcgccgtccagggctgggcggcgagctggtcggtgcgagcttcgacgcctcggtgtgcggcagcgccccgctcggtggggcgcccctcccggtcgagccagccgcgctgggccaacgcccgggccgcggcgtcccactcgctgtcggtccagccccggttgggttgcagttgctcccggcccccgaacagggcgctgcgcagcacgagcgcctggcagccggtgatctcggcgtcgaccagcgcggcgatgtgcccgtccccccgatgctcacgcaacaccgtggcggcgcgccacagccgggcgagggtgtcgccgggctgcggcaacgcggcgttggccgcaccgagcgcccggccgtcggtcaccgccgcgcgggccgcgatctccagcagctcggcggcctccgcccagcgctgcggctccggcggcaggacggcccgcagcgcctccaccgcgccgtcgaggcgggcggccagggcttgttccggcgacacccgctgccacacctccggtacggcgcgcgccaccatggcgggtgcgaaggagtagaacagtgcggtgaccggagctgctgacaccgcgcccagcggagccgctcgccccgcgaagtatccgcgccagtaccctcgcagcccggcgccctcgaaagccacccgggcctgcggtgcgaagtaggtgaccgcgtgcaggggctcatacatctgccacaggtgtcggaccggggacatggggttgagtcaagcgcagttccgggcgccgatgaacggccaatcgcgacatcgtggcccgcagaatgcggaagggccggcgccgggcgccggccctgttgcatgtcgcgatcagccgatggtcatggccccgccggtggctgaggacggcttgccgtaggcatccccggcgaacttgaccatgacgcggaactgcaccttcctggtcgcgctgaccagcccgatgtagtagacgccggaagcgtccaggctgaagtccttggcctgtaccgtccgccacgtgctgccggccttgccctggagcacgatggtgatcttgcggccggcgaccggtgaggacacggcgaccttgatgacgacgtccttcttgtcgtggtagtaggcgaccttcttcaccgtcttgtactgcccggagaggcggaccccggcgatcgtgacggtcttgtaggcggccttggcggacgacggcttgttgctgtcgtcgccgtcgtagtaggcggtgaccgtcccgccggccggtgccgggatgtcgacggtcgccacgccgcccgcgttcgtggtggcggtcatggtgagggcgcccgccgggctggtgcggacgaaccggaccgggacgcccgggtggccggccacggtggcggtggcgcgaaccttggcgccggccttcgcgggctggaccagggcaagcttggtggtggtcgcggccggggcggcgaccgtctcgaagccccgcgcgaggtagtagacgtgcggctgctcagcccggccggtgaagtcgtcgagaatcgcgtagagccgagtgtcgtcggcggaccaggtcagggttccggcgaccggggccgggcggttgtacgcggccttcgggtgggcgttgccggcgaggacctgggtgcccgcggcgacgtcgaacgcgacgatgttcccgtccggcccggagccgctgtccaccccgccaccgatcatggcgccgcggtgcgagtaggcgacgtcggtcggggacgcgcccgtgtcgaacgagccggccaccgccagcgtggcggcgtcgtactgcgtcaggtggtacggcgagcgggacgccgtggcgaccttcgtaccgtcggggccggccgagacccgggccaggaaccccccggtgtccttctgcgccagcggggtgacggtcgccccgtcgacccggtaggtggagagcggaccgctgctgatcccgcccacaccggcgacgagggtgttcccggcaccgtcgagcagcggtgcggagtacatgcgagcggtcgtcacggtctgcgggtcggtgccggtggcggcgtcgaccgagccgagggagccgccccactggtcgcagccggcgccgtagaacagccgggaaccggcgaaggcgaggtgcaccggacactgcccggtggtgtagcgcgcgacctcggtcagggtggcggtgtccagaacggcgacggcgccggcctgactgagcgcgacgtagacccggtcaccggacggcgacgccaggacgtcccgggcgccgaacatcccggtgacgctcttctgcgtcacgccgtcggtgccgaggacggcgacggtgttgccgtcggagacgaacagacggccgccggcggccgccatgctctgcggcgcggccagcgtcgtggatgtcgtggatgtgtcggtcacggtggccgcgtgcgccggagtggccgcgatcagggtggcggcgacggcactggcggtggccaggacggcggccgcggggcgggagctgaggggcatcgcgtcgggggtccttcggtcggtcgcggacaagctggtgcaggatcggcaccgggcggtccgagctttagcagaatcgacccaccggcctgttcgcccggaccggtgcgcccgcccgccccgcggccacgatgattcaggacacaccgacggcccgctcgtcgtcatcgcccgccgcggcacccaacaccacttcgaacgcggccggctccaagaacgttctggaatgatcgcagcgtgacaccgaatctcgacgcgccggtcctcggcggcccgcgggaagcatccatcccggtctccggcgacggtcggctgtgggccgagcgcgttggcaccggcagcccggttgtactgctgcacggcgcaggcatggactcccgactgtgggagcgcatcgttcccgagctggcccggtaccacgacgtggtccggtatgacgcccgaggcctgggccgctccacgccaccgaacaagccgttcaacgacgtcgatgatttgcgcgccgtcctggactacttcggactgcgccgggccgccctggtcgggctgagcatgggcggggaaagcgcgctggacttcgccctcacccaccccgcgagagtcgccgcgctcgccctggtcggcgcctcggtcagcggacaccgctggcctcaggagcccgacctgagcgcctacgccaccgcacgccgggaacgggacgtgagcgccctggccgaactcgaactctccatctgggcaggcatgggcccgacagccccgggatgggagctcatcgacgcgatggtcacgcacaacgccgcgcggcgcatcgtcagcgaacagcaatgcgtcacaggccagaacgccgaagcgcacctcgcggacatcgccgcaccgacactggtcgtccacggcgaccgcgaccacccggagatcggcgtcatcgcccgactgctcgcggcccgcatccccgacacccacgccgtaaccatcccgaacgccgaccactacctgccgctgcgtacgcccgaggccctcaccgaagttctcctggaacacctgccctgacacgggatccaccgaccgccgcgtcaccaccatcgacaattgctcagtcgcagaaccactcaccggagacctcgtcagtatcgatgaccgccgcacgtggtgacgtccatcaaccgggtgcgtgtacctgtccgacagcatcggcgccggactcgtcttcggcggggcactgttccgcggggacgactccgccgccggacgcttcgggcacatgtcgatcgaccatcagggacggccctgcccgtgcgggcggctcggctgcgtcgagcggtacgcgtccaccgcggcggtggtggcggcggcccgggccgacccggtcatgcgggccggattgagcctggacggtggcacggcggcggcgtacgacgccgtggcccgggccgcgatcaacggcgacccggacgccttcgccctcctcgaccgggccgccgcccggctgggggccgccgtgacctcgatggtgaacctgctgggcctgggccgcctggtgctcaccgggccgggcgtcgccctggccggatcgatctacgcccgccgggtgcgcgcctgcctggaccggcccgaggtcagtgtggagatctccgcccaaccccgggacgcggccggcatcggcgccgccgccctggtcatccaagcctccgtggcgcccgggcacacccccgggcgcgtgtcatgagaaaggagtccgctgtgccggatgcaacggccggacggccccggcgggtcggtctggtgctggcccgggcctcccgggtactcggcgaggagccgtactaccacgaattcatcgagggtctggagcggctgctcatcccggccggcatctcggtgctggtcaaagtggtcaccgaccacgccgcggagatcgccacctacgagcggtggtcggccgagcaccgggtggacggggtgatcatggtcgatctcagccccggcgaccaccgcgtcgacctggtgcgccggctcggtctgccggctgtggtgatcggtgacccgtccaccgcggacggcctgccgaccgtctggaccgacgacgccggctcggcccgcgaggcggtccggttcctggccgaccgcgggcacacggtgatcgggcacgtcagcggaccgctgacgctcgcgcacacccagctgcgcctcggcggcttccgcgccgaggcggccgcccgcgggatcatcctgaccagcgccgagggggacttctcgcacgagtccggccgggcggcgaccgcgcggctgctgtccgccggcgcggaggttcccaccgcgatcgtctacgacaacgacgtgatggcgctcagcggcctcgtcgcgatcaccgagcgcggtctgggcgtgcccgccgacgtgtcggtggtggcctgggacgactcggtgcagtgccagctggccgggccggcgctgtccgcgatgagccacgacgtcggccggatcggcgagatcgcggcgaacgccattctcgacgcgatgcgcgacatctcggcgacccaggtgtacgaggcgccgcaggcacacatcgtggatcgcgacagcaccggccgaccgccgcttctctcggcccggtgaccgtccgggggtgcgattcaacccatgtcgtcaggacgagtgcggcgtcgtgtgtggccgtcctgcgaccatggtcaacctgccgggtggaggtcgccttccgtgtggaggtcgcggagggggcggacgccgtcgttgcggagggtcccgcgcagtctgcgcatggtgtcgtcgtcgtccacctggtcggagcggcggagccagtgctcggcttcgtcggtggcgccgcggtcgcggaggaggccgccgagtacgtacatggcgaagctgttgtccgcttcggcggcgcggcgcagccagatctcggcctcgtcggtggcgccgcggtcgcggagaaggctgccgagcaggctagctagctagcctcggcctcgacggtcgcgccgcggtcgcagaggaggtcgccgaggctgcacatggcggagtcgttgcccgcttcggcggcgcggcggaaccagcgttcggcttcgttggtttcgccgtggtcgcagagaaagtcgccgagtttgtacatggcgtagtcgttgtccgcttcggcggcgcggcggaaccagtgctcggcttcgtcatcgtcgccgcggctcaagtggaggtcgccgaggctgcacatcgcgaagtcgttgcccgcttcgacggcacgacggaaccaggcctcggcgctcacctcgtcgccgcggctcaagagaaggtcaccgagtttgtacatggcgtagtcgttgtccgcttcagtggcgcagcggaaccagtgctcggcttcgtcgtgggcgccgcggctcaagtggaggtcgccgaggctgcacatcgcgaagtcgttgcccgcttcgacggcacgacggaaccaggcctcggcgctgacctcgtcgccgcggctcaagagaaggtcaccgaggctgcacatggcggagttgttgcccgcttcgacagcgcgacggaaccaggcctcggcatggaccttgtcgccgcggctcaagtagagatcacctaggcggtccatcgcgtagtcgtggcccgcttcgacagcgcgacggaaccagatctcggcctcggctgtatcgctgcgcttccacagcaggtcagcgagttccaccatcgacgtggtgcgggccgggtcggcggcgatggcccggcggtgccacgcctccgccttgacagggttggcgggcggctggtcggcggggcgcagccagcgccgccaggggactcggctcacaacggccatcgtggcacacgaatgttaatgccggccgttcccgaacgtcgcgagcggaatcggacaacgactccaggcggcacggagcacacgtcaatgcggtagggcccgccccggcgaaccagcggacaccggggccgggccactgaggtgcccagttgggtagcgcgatcgggtagcgccgagcgcgaatcaccgcgcaggctgccgcgccagccgcgggtgtgcagctcggcgcgcaacacggtggcgtcgatcagtccttcggcgcggcgccggtcgccgcccgccctcggcgcctgcccaccgaccagggccgaactggacgcgtgctgactacggcgtgttcccggaggtctgcggctgcgtggcggccggtggtggcggcagcacccgctgcacgaacaccgccgccgcgccggtgccgaccgcggtgaccgtcgcggtgacgaccgagaccagcatggtcgacaccgaggcggtcagcacgttcatccggtgcagctcgcgcaggtgcgcccagccgtagccgaagcggcgcagcgtgagcagatcggtggcgagccccatcaccaggccgaaggccagccactgcagcgtctgcagacccgccgcggccagtgccgaggcccgcgtcggatccggcagcagggtgatgatcagggccgggacggtcatcgtgacgaacaggctcaggcccttgccgagcccggtgcggccgcgcaccatcgggtacgcgatgccgagcaccaggcccgcgatggtgaaccgggccaccaccaggatcccgccggccgcgtccaccaggcggaacggtccgcccgaggagagggtggcgagcaccgtcgacaggtcgatcagcgaccagggcaggcccaccagggtggcgagcagccccagcgtcagggcgaggcgccacggggtcaggccgcggtacgacgacagtgccgaccagaccaccgtcgccgaccggcacggcgcgccggcgaggtccgcgacccgctcggcgcgcgcgtcctgcaccgcggcgtcgggatgcccgtccgcgacggccctgcgcaggtcgcggacgagcgactcggtgacccgcgcccggaccgccgtccgggtcagctccccgacctcggcacgggcgacgaactcctggtccggtccgaccggcggcgacagatccggaacgggccgcggcggcagcagccagcggtggatcgcgaggagcccgaaggcgaaggccagcggcagaccggccgtggtggcggtcggcgacagcagcccggtcaccgcgagcagcgcggcgaccgcccggagctgcccccgggtgcccaccgcggtgcccccgtccggcacggctcggccgaagtgccacatcaacaacacgagaaggagtaccgcgacggcgcgcagcgtgccggcgatcgacacactcagcgacagcgtgtcgtagaaggagaaccgtggcccctcgtcgccgtagacgaccacgggcaccgagagcgcgacggccgccaggagccgcagactccgccagggccgcagccgggcgtgcaggccgagccaccacgacggcgggtcggcggtgacggcatgccgcaggatccgttcgaacgccgtccacaccgccacccccgcggcgatcgagacggcgccctgcaccaccgtgctcacggtgtcgatccgggagccgaacggcgtcaggtacaacagcgcgagcagcaccgcggcggtggccgccgccgtccgcacggtgtggccgcaggcccggatcgaccaggccagggccgcggacgcggtgaccagcagcaggcacaccagcagcagcgtgatggcgtagccggccgcggtaccggtcagccagtgcagcggggacggctccgcgaccggcggtaccccgccgatcgcggccgggcgggtcgccgggaccgtgacggcctccgactgtggcgaagccccggcggtcagcatcgccgaagcggggacggccagcacgacgaaggctacgaagatcatcgcccagaaccgtctcgcgcgggggtgccgcaccgtgagcaccggccacagcgcgagcgagcgccacagcaccgcggtgcacgccaccatggccagcgggaccagttcatagggcgcatacagcgacgtgggccagggatggccggtcaggctccagtggaacagcatctcgctgaccacactctgggtggccgagccggcgcaggcgaggacgccgaacgccgtcatcgacccgaagacgtgcacgacccgggccggcaactcgccgggccacgcccggcctcgcatcgagcgccacatcatcaggatcggcagcagaagcagcagcccgaaccacaggttccgcagcgccacggtgatctggcgcggcagtccgaacagcggccgcggacgggtgccggcggcatcggccggacccgagggctgttccaggtcgaggtgcgcgccgccgaggccgtggaaggtcaccgatccggcggtctgctcgtcccaggcgccggtggggcagtccccgcccgccggctcggcggtcagccgcctcggcacgagtcgaccggtgttgaccacgaccgttcgggaccggaatttcccgcagaacatcgtcgcgggaacggccatcgtcgtccggtcgcgcaccgggaccagcaccgagccgtgcaaccgcacggtcgccgcaccggggcggacggtgacgaccggatcctcccagtgggccgtgtaggtgaaccgcacggcggcgctgcccagcagggccggaatctgttgctggtcggcacccgagcgcagcagggacaccacgggatggtccgcgcccggaaaggtgaacgtcgcgtcgacgtcgaagtatcgggagccgccaccgactcggcccggggtgaccgtcacgtccagtcgcacgctgccgtccggggcggcgagccaggcgtcggacgccgcccgcacccccgacgcgtcgtaccggagcagggcgaccgccagccgggacgcgggcgccgcgaacgaggtgagcagcgcgccggccagcgcggcgagcactgcgacagcgatcgtcaggaccgtccacagcagcacccgcacgaccggccgggccgttgcggagggatcggtggcagccatgacggcatggtcggggaccgccaccgggcaccgggcgcttgccgcggaagttcgcccgtccgagaccgttgatcgcggaggatagatttccggcatgtctgagcagtggcgcgtcggcgcggtcgtcctgggccgctacgaggtgaagggtgtccacgagggcggcgccatggggctggtctaccgggtccggcaccggcagtggaacaccgacctggccgtcaaggtgccccgccccgccgtgctgaaccagcccgccttccgcgggcagttcgtcgccgaggccgagacctgggtcggcctcggcatccacccgcacgtctgcacctgccactacgtgagcaccgaggacggcgtcccgcgggtcttcgccgaatatgtggacggcggcagcctgcgcgactggatcgacgacggccgactctacgagggcggtcccgccgacgtggtggcccgggggctcgacgtggcgatccaggtgtgctggggtctggaccacgcgcacacgaaccggctgatccaccaggacgtcaagcccggcaacgtcctgctcgacgccgacggaaccgtcaaggtcaccgacttcggtctggcacgggcggccgcctcggtgccgcccgccgggccggggccggtcgacgggacgctgatggcgaccaccggcgggctcaccccggcatacgcctcccccgagcagatcgccggggcgaagctcacccggcgcaccgacgtgttcagcttcgccgcccttctcctggagatgctgaccggcgaccgcacctggacgttcgggccgatggccgccgccgccctcgccgagtacgtcgccgccggccggatgccggcccggctcggcggactgctgactcgctgcctgcaggaggacccgcagcggcggccccgggacatggccgcggtggcggctgagctgatcgacatctaccggacgatgctgggccggccctatccgcgtccggtcccccggatcgccggtctgcgcgccgacgaactgaccaaccgcgggctctcgctgctcgacctgggccgcaccgccgaggccgaggccgcgttcgccgaggccctcgccgccgacccgcagcatctggaggccacgtacaacgccggtctgctgcgctggcggcaggggcagctgtccgacaccgccctgctgacctcactcgacacggtccgcgccaccaccggggacccgtggacggcccgctatctgacggccctcgtccatgtcgaacgcggcgatctggagtcggccgaagccctgctcgccgatgccggtgacgacccggatgtgcgggccgcccgggacctgctgcgcgccggcgcggtcaccgcgagcggggcacacgccgtcttcgacggtcacgagagggcggtgctgtgcgtcgcggtggccgccgaccggcacgtcgcggtcaccggcgacgaggtgggcacgctgcgcgtctgggatttcgacgagccgatgctgcggtacgccgtgaaggcccacgatcacgccattctggccgccgcgctcagcgcggacgcgaaggtggtcgcctccgtcgacgccgacggcaccgtccgggtccgtgacctggagcgcggctggcgcccgcggccggcgcaacgcaccctcaccgggcacacggacaagccgagcaaggtcgcgatcagccacgacggccgccgggtggtcaccaacgacggcccgcagatccgcgtctgggacgccggcaccggccgctgcctgcgggtgctgaccgggcaccccggccgggtggtgatcgtcgccgtgaccgccgacggacgccgcgtgatgtcggtcgacgccggccgggtcatgcggcactgggacctggacaccggcgtctgcctgcacgaactgcccgcccccgactggccgggccacggggcggtcagcgccgacgggcggctgggcgtcgccgcgagcaccctctccggcgcccacctgtgggatctgcgggccggccggctggtgcgcacggtccaggcacactcggacacgcaggtgttgttccggcacgccccggtcgcgctcagcgccgacggcagtcggatgatcacctccggtctgcatcggacgttccgggtgtgggagaccgccacgggccgctgcctgcgcacctacaccgcacacgaggccgaggtgtgggcggccgggttgacccgcgacggccggttcgccgccaccgccgaccgcgacggcgtgctgtactggtggcggcttcccgacccgcggccgagcccgttccggctgtgccggccgcgaacccacgtcgagctcagcggcctgcagatccgggtcgaggcgctgctggccaaggccgacaaggagctggcggccggcaaccggccggccgcgctcgccctgctccgcgaggcccgggccattcccgcccacgagcgtgagccgcgcgtcatggacgcttggcggcgcctcggcgagcacaccacccggtccgggatccgggccgtctggccggtccgcacgctcgccgaggacgccggcatcacccgcggcgtcagcctcagcgccgacggcaccctcggcctgaccgccagcgacaacgcggtccgtttctggcgcaccgacggcagcggggcgtacgccgtccacgaccccggcgactcccccggcaccgcctcgctcagcgccgacgccaccgtcggcgtcaccggtggcctgcgcctgcacatctgggacgcccgcaccggcgagttgcggcgctcgttcggcgggcacacccactacaaggtgctcagcattcaggtggacgccgcggcccggcgggtcgtgtccggcggcggcgaccacgccgtacgcctctgggatctggagatctacaaacagatccgcgccttcaccgggcatcgcacccgcgtcacgtcggtccgcttcgaccccggcgaaacccggatcgtctccgccggcgccgacggccaggtgcggctctgggacgtcgccagcggcgaatgcctgcaggtgttgaccggtcatcgcggctgcgtcaacaccgccgtcctgaccccggacgggcacaccctgctcaccggcggcgaggacggcaccatccgctgctgggacgcggcaaccggcgaatgccggtgggcggtgcaggcagacggcgactgggtgaacgacctggcgccgaccagcgacagccgcttcgccgcatccgccggctacgacgccacgatccgcttctgggatctcaccaccggcgcctgcctgcaggtcgtggagggccacacgtacccggtgtggtcggtgtcgctgagcgccgacgaccgctatctgctctccggcagccacgaccagagcatccgcctctgggaggtcgactgggacctctagcaggcactatggtgtcgcccatgatcgttgaggggctcgggtgggtcgcgcggcggcgggtggcggtgctggtcacggcagtcctgctcgcggtcgctcagcaggtgtcgctgccagccgtgcactcccggccgctggacctgaccatccgcatggtgccgtcgaccgcgctcatcctgggcgcggccctcgccgtccgcgtcttcccgccggcgaagctcgtcgcccgccccgcggtgcccgccctcgacaccccggcgagtccggcgctcgtcctgatggccgcgagctacacgtcgttcgccgccctccttctgaccaccctgatccggaccgtcgagaccgtctccgatgtctggttcgcggccctcccggtgctcatcatcggggccaacctggccgccgtcggtcggctgatgctgacccggtccggggttcgcctcaccccggacggcatcgaggaccgccggatgtacggcgatctgttcgtgccgtgggcggcgctgaccagcccggacccggcccatgtcaccggccgtcgacaggtggggctcgccatcgcccgccccgacctggtccgcgtccgcggctggcgggtcggcccccgcaccctgctccccgccgtcggcgtcgaccccgacgtgctggcccgcacgatcaacgagtacgccaccatcccggacgcccggtcgaccatcggctcggcgatgcccctcgccggctctgccacgaccgcggtggcctgacgacctgccgggcgctcaccgcggcggcggtaccggccgtggaaggcgggcaggccccgtcgtggtgccggccggggaccaggcgatccagccggcgtaggcacgtcggcggtcgcccggcgtgatggcgggatcccgggcgagccgatgcagcagccgggcgccccggctcgggtcggcggcgagtcgcgccagggcttcggcgaccgccagggtttcggtcggcgacagcgggccggtgacgagccggtccgcggccgcgacggcgatcgggcgcaacctggcatcccatccggcgagtgtcgccgcggccagggctgtcggtgcatcgtcgatccggttcaggaccagggaccgcaggacgtcgaggccgtcccggcgggttctgccggacagggtggtcaacgcggtggcggccgtgcgtcgatgctccaccggcgactgcgggtcgtgggcgaccgcggtgagtgctcgagcggcggcttcccgccgcgccggccggacctccgccaggatcgcgtgcgccatggcctgctcacatccggacagctcaccgtctgcggccaggtcgcggagcagctgaaggccggcggtggtgccgcccagccggaccaggatggcggcggccccggcgcgttcccggacgtcggccgcgcggtcggcggcgacccggtcgagggcggccagggcggcggggcgggccggcgggccgtagggaagaaggcggtccaccacgtagcggacctggtcagcggccaccgccgggtggccggccagctgctccagcacctggatcgtcgccggccggtgcgccgggtcgagggcctcgtacgcgaccgcgcagtccgccctttcccagacgtcggcgtcggggtcgcgcatcaggatcgcgagaccggcggcggcacggcgccgatgctccgggccgaggcgggccgccatccgggccgcttcccgccgctcccagaggcgcaggttcgcgtcggcggtcacggcgtcgagcagttccgcggctgcctcgatgtgtgccgggccgagtcgcaccaggtacgccgcggcccagagccggtcgttcggcgagttcgcggcgtcggcggccacctcggtgagcaaacgcgccgcacggccatcggatccaccctcgataccgaccaacagagcggtggccatggcctgatgcagccgcccggggtggtcggccgggagggcgattgcgcgcaggcgttccgcggcgagaccacgcgctgcggagcccaacccggcgaggtggccgatcagcacgaaccggtccggcacggcggcgcggtccgcctcgtcggcgagcagccgggccgcgtcggcccgggcggactccccgaaaccggcgagggtttcggcggcctggccacgatccgcggccgcgatgccgcgttccctgatcaggtcgcgcagcatgtcacggtgcaggtcggtgctcgccggctcgcgctgcgcgagatcctggatcgccctgatccgctcatccgccgcgaccgtgccgtcggcggcgagctcgcggagaaggcggcatgcctccgcgcgatgcgcactgccctgccgatacagcgagacggccgcacctcgtcgcgatgcagcgggggcgacggggtcgacggcgagccggcgaagtgtcgtggtggcctcgtcgattccggcgccgcccagggagaccagctcccgggcggccgccaagcggcccccggcgggcacctcgctgtccgcggcgagggtggcgaacatcgcgatcgccgacgcccgccggcccgaatcgaccttgaccagctcggccaggacggggacgcgatcctcatcatccagatgcgggtcgtcggcgatgccccggagcaggtccactgcccgccgccgctgcccgtggatacggagcagtgcctgcgccgcgtcgagccgggtcgagggccacgcgccggggtcgccggcgatgagggcgagcagatcaccggcccgatccgcggcctggtcgccgaatcgggtcaccagggtcgcggcctcccgccgggtctcgtcgtcctgcgccgggtccgaggcgagctccagcagaatctcggcgatctgcggccggcgcgggtggtcggcccgggccaccaggtgggcggccctgacccgctcggggccggccgtcaccgcgacgacgatccggctcagctcggtgatcgcctgcacacgcctgtccggctgcagacgggccagcaacgtcgccgccgctatccggaccgttgcgttgatcaacggatcggaggccagcgcgccggcgaggcgacacgcatgctcctgcccggtgacccatccggtcagcgactgcagcgcctccccgcgggtcgggtcgtccgtggcggggtcggcgacgatctcggcgagggcacgctgagcggcggcggcaccgccgcggagggtgcccagctcccgggcaatggtgaggcggtgctccgcgtggggtccggctgccatgccggtgagcacctgcctggcaaggacatgggtctctggccgcaaccaggcgaggaaggcggcaccgacggtctggtcgagcggaccggcatgctcgtcggccaccaggcgctcggcgagagcgcccgccaaagccgaccgcgtcccacccagctcggccaaggattggcctgccgacaggcggtcatggagcggcaccgttggatcggtcagaagcccggcgaatatgtccgcggctcgatcagtatggtcagggccgaggtcgcacagcgccgatgcgaccgcgctgcgctcgttcaccgccaagggcacgcgttcgtaacccgccagaatcgtgagtgaatgatcttttgtgagtgatggatcccggaggcatcgaacggctcgcagccgcgtagccacgggcagggtcggattcgtccaaagctcccgggcgatctgcgcgaccatgggcgcgtcagacttttcgagtcgttccatcacccacaaacgccaccattcatccagacgggggtcagcacaccactttcggcacaggtcgatgagcttctgtcggtgcgactcctcttgctccagacgccgcgcggcttccgggagcagcgacggtgaaacgtctcgactctcgagaacctggacgagagcggtcgcgaagatgccttgatcacggctttccagcgattcggcgaaggaaatcaacaggcttcggtcaggctctgcttgtacttcctcgcccgccgaacgcagcactttgacggcttgatcgcgatacttctcgtctgcctggacaaggtcctccgcggctcgacagagaccgatcacctcgagttcgccataccgtcgaaaatggtcgaagacaattctcgccaagcctggacgaaaacgttcgagaatgacgatatcatcagaaaataggtacagtgcacctaccagcggatccttcaagatctcagcgaccgtttccgcggccttcaccgccgagttctgagaaaaggagcgcagccgccaaacgatcgattgcaggtcaccttcggcgggccaggggccggtcaagcactggaggagcagggcactcgcctctgctcgatatgcgtccccgagtccggccaggtcggagacactatccccgtagtcagaaggatcacccgcagtcgagatcatctcacgcaggagctcggcggcctggctccggtgagtctccgccacctcggccagtcgtaccgcagccgctcggcgtgaaaagtcgggagagagcggatcggtcgcggccatcagtaacaaccgtgccgctcggtcgaggttgtgaccggccaactgcgccagagcatgggcagccgccaatcgggctacgtggtggccgtcggcgacggccgccaggtgatacagggtgtcagcctccgtggtagcggaatccggctccagtgaaaccaggatcacggccgccaatatccggctggccggagtgatggtgggatcggccagccactcccggaatcgggtcctgacctgggtacgtcgctgttcgtcgaggttggccgcctccagcgccgcttgcgcacgatcattgagatccgtggtggcggcggaggcgatttccagcaggcattgcgcggccatctcacgcgcggcaccctcatgacgggccagcaggcgcgccgcacgacgccgcgagaagctgaccgccggatcaccgacgacagcggtcagcgcctccaagctccattcccggtaggcggggccgagcgcggcgagagcctctgccgccatggtacgcagaacccccaactgtgtggagaaagccatgtctctcatggaccttgccgcgcttctgcgggcagacccaccgaggctggccagctcacgagcagcgttcagccggaggtgaccggcgacccacgggtcctcgcacacttcctgcaacagctgtgcagcgcgattcctcccatccgcttcgagcagcgacacggcggcgagccagagccggcggtcatcggagtacagagagccaaaggagctcgcgctgagccgcagggcgaccatggcacggcgacgatggtcgccgcccaacgccgcgaggctctccgcagcgctgcgccgcgcttgtgggtcgagcgcggtgtcagtggcgagtcgggacagcagatcggcggcacgattgcggccggccgagccgagccgggcgaggttctccgcggcctggcggcgataccagccctcgacgcccgcatcctcggcgacctggtgcagcaggtcggccgcagccgttcggtgctcgtcgccgatcgaggccagtgccgtggcggcagcggtccggcaattgcctgagaggtcacggttcgccgcgatccgcagcagcgccgccacggccatcgaggcgtagggcgcaccgagtttggcgaggacttcggcggcaccggagcggatctcgccaggttgtccgggatcttcgagcagcccttcgagggttctcgcgccttcgtgccgcacctgcgggctgcgttcccgcatgatgtcgatgatggccagtttgatccgggccggagtccgctcgtcgcggagccaggtgtacatccgttcccgcacggcggggtggacagtgagaccggacgccggtcgcaggtccagatccacgtcggcgaagatctgcccttccgtggtgtccaggaaagcggccaactccgcatcggtgcggggcgtgccctggaggatgaggactccggccttctcccgctccgcctggctacgtgcttgcagatacccgatcagaccgctgtccgacctgtgcagatggaggtagtgggccagggttctttcagcggactcgtcgtcgagcaggaattgcctgatcagctctcgccagaccggctcggcaggggcgaatctgccgggcagggcacgggcccgggcagtggccgccagatgctcggcgaaggtctggtgctgaaatcgcagccgcaccccgtgccagccgagcaggccggcccgagacagccagttccccagcaggctctccccaccgaccggcagcatcgtcagcctcgggccgtgttcgtggacgtagcttatggccacctcggccagcggtgtctcgctgcgggtgtactcggcggccagcgtttccagcagggtggtccgctgcgcgtcgagccatgcgcaccaggccgggtcggcggcggcgccgaacacttcggccgcggaggcattgcgggtcgcgaggtgggcgatgtatgcctcgtacagctcgtatcggttcgacggcaacggttggtcgcggcggcggtcggtgaagacctgcgcggcgaccgtcgcgagcaacggcacggtgaggacctgttcgaggccggcgaggcggacctggctgaggaattccgccgcctcggccgctcccccggccgtcccgtccgggttgaagtgccgctgggcgaacatctccagagccgtcgcgtcgaacggctggagttcgaagaaccccacccgcgggccctgcagctgggcgatctcgcccggtaccagtggacggctggtgaccagtaagcgcgccggctccggggtggccatccgggtcgacagcaccttgaggagccggtcccggtcggcctgatcgggaatctcgtccagggcgtcgatgaccacgagccagttccgcccggcgatcggccgctgaaaggtgtccgcgctgacgccttcgagtgctccgtactcagcggtcaccgcctcgtgcagcgcttctgcccagggtcgtccgatgtgcctggcgagcacccgggcgggcagcatcaccggtatcaggccggcggtgggaagactgctcgtcctgccgtccagcatcgtgccgatgaggtcgccgacgaggaaacggcccagggtcgacttgccgagcccggccgcgcccgcgatcacgaagtggtcgtactcgctgaacacctcgtcgaagggctgggcgagccgggtgacgcgacggtcctcctcgaccatcgccacctcgtcgagctcgcgatcccagacctgacgcacggcctcgaccgggctggcgacgctttggctgacgtagaccgtggagagcgcctgcaggtgctgacccggctgctgcacgtacggatgctcttcggcgtacagcctcatcagccgcagcagtccgatcaccgccgccgggatcggggctgccgctcgtggggtggcgcgcttgccggggcggccgccgcgctgggcgcggcggtcctgctgggcctgccggtgcagccgcagccagtcctccaccgggggcggccgttgcccggtgcgcttcgcgacaaggtcctggaggaaggtcaccacgaacttgacggccgccgcgctggtgggcaccgacttgccggtgagccagtcgctcaggctgctgtccgacagccggatcgccggccgctggacgccggcctggcggatgaggatccgatactccggggagccggcggccgtgtagagacggtggagctcgtcggcgaagcgccgggcggacggcgcctcaggctcggtcaccgcacgatccgggcgacccgtccagcattccggcgccggatccggccgtgagcgcgttctcgcagcatgaacgcaccatagacaacgatgatatcgccggaaaccggccggacgggcgaaatggccgcatcgccaccgttcgctggagggaatcgcgatgtcactgctcaccgatctcgtgccggaagtcctgcatccggacgggggcctgctgaccggggcggcaagtctcgtctatgccggcaccgtcaccggcgccacgatcgcggcgctcttcagccgcgaccccggacgacgccgtgccgcccggtacgttctcgcactgctcctgcgtcggaccgggggcggtggatccgacacgcccgagagctgaccgggacggcaccgtggccgaatggggttgcccggcaatcggcccctgtccagaatggcccggtgcaggtgcgagcgctcgatccccatgacccggaggccggcccgtggcatgcggcgttccgtgccggtctggtcgccggccgcgagcagccgaccgtggccggtgccgagtcgacgctgacctcgctgcgcaccatcgccgacaacgccgtcctcgaccgccgggcgttcggcgcgtgggacggcggcgagtgcctcggcggcgtcatcgtggacctgccccgggtggcgaacacgcacaccgtcgggttcgagctggcggtggcaccccggcatcgcggccggggcgccggcacggcgctgtgggaggcggctgtcgcggtggcccgggagcacgggcgccgggtcgtctcgaccgagcttccggtcccgctgaccgcatcgctcgcccagcaccccggcggccggttcgccctggcccgcggcttcgccggcaagctgcaggagcgccgctacctgctggggttgcccgccgagccggtggccgccgaggtgcccgccgggtatcggctgcactcctggacgggaccggtgccggccgggtcggcagccgacttcgccgcgatgtgcacgctgatggagcgggacgtcccgaccggcgaccgcgaccacgatccggtcgtcgtcaccgccgggcaggtgctgcgcggcgacgagcggctggccaccgggggctgggggctggtcacgacgctgctgggtgccccggacggcaggcccggcgggtacacccggatcttcgtcaacgccgaccgccgccacgctcagcaggacgacacgttcgtgctgcgggcgcatcgcggccgccgtctcggcgccgttctcaagtccgccaacctcgcccggctcacggagcatttcccgggcgttcgcctgctgcactcgtggaccgccgatgacaacggcgcgatgatcgccaccaatcggcgcttcggtttccgccccgtggagatcctgcacaccatggagggcccggtcccgtgagcctgaggaggtgcgcccgccgggcgcacctccggcggccgctcagcagacggtggcgcggcggatctcggtgcgcagggccggggcgccgtcgaccggggccgggtcgtccgcggtcggggtgatgccaccggccgccacccggtccagggtcgtcaggccggccgggcggaccgacccgaagacggtgtagttcggacggagcgccgagtcggcgtagaccaggaagaactggctgccgttggtgtccgggccggcgttggccatggccagcaccccgcgggcgtagaggcgccgcacgccggtcgggtcggtgggcgcgggcggcaggttgaccggcagctcgtcggcgaaccggtagccggggccgccctcgccggtgccggtcgggtcgccgcactgcagcacgctcagcgtcgggtatgcggtgagccggtggcagatggtccggtcgtagaagcggtgccgcaccaggtgcaggaagctctgcacggtgcacggcgcggccgcccggtccagccgcagcgggatcgggcccaggttggtgcgcaggaccacctcgacggtgccgtggtccggggtgtgcgaggtgttccggggcggggacaccgggcgggcggccggatcgtccggggtgggggtgtaggcgcaggacacaccatggtggccggcggcgttcgccggggtgggcgccgcaccgagggtcaccagcgcggccacggtcagtgccgccactactctgcctgtcaacgtgtgggtcacgtcgtacacactaatcgatgactttgaattgacggcaggtcgcgcggccggtcgtggacggcggaacgcaagaaagcggccgggcatccacgggggagaatgcccggcctggttagatcaaagcacatgatcggtctcccgcgccatccggtcggctttaccttcggcacgcggccatggagaatcggccaccgcagatcgcctagaccacgggaacagccatgccattcgatggtttcatctcctacagtcacgccgctgacggacggctggcgccggccgtccagcgcggtctgcaccggctggcgaagccgtggcaccggcgacgcgccctgtggatcttccgagatcagacggggctggcggtcacgcccaagctgtggacgtcgatccaggacgcgttggacggctccacccacttcgtgctgatggcctcccccgaggcggccgcctcgccgtgggtgaaccgtgagatcgaacactggctggccaccaagtcggccgatcagatcctgccggtggtcaccgacggcgagtggtgctgggacggcaccgcccgcgacttcaccgaggattccaccgcggtgccggccgcgctgcgcggcgtgttcgaggaggagccgctctatctggacctgcgctgggcccgtgacgacctgcacctgaccctgcagcacgtccggttccgggacgcgatcgcccagctcgccgcgccgatgcacggggtcagcaaggacgagctggagggtgaggacgtccggcagcaccggcgggcccggcggctgtccaccgtggcggccgcggtgctggtcctgctcaccgtggtcgcctcggtgaccagcgtggtcgcggtgcgcaacgcggagcgggcgaacacctcggcggccgaggcgcaccgccagcagcaggtggccgcgcagcagcggaccaacgccgagcgggccaccgaggagtcggtgcgccagcagcagaacgcccaggtgcaggagaaccgggcgcgcgacgccaaggcggagaccgagcggcaggagaagctggccgccgaggcggccgccaacgccaagcgggagcaggacgccgccgcgcggtaccggatcaccgcgcagttccagcagaagctggccgaccaggcggcctcgcgggccaaggaccagaaagcgctcgccgagcagtaccgggacctggccgaccaggccgatcaggagcgcaagaagcaggagaagctggctcagcaggcgcagcaggaggccgcgaagcagcgggccgaggcggaccggctgcagcgcatggaggtcagccggcggttgatgatccgggcccgcgagctgatcgccgacgatccgcgtcaggcgctgcgggtgggcgcggccgcggtcgccctgagcccggacgcgagcgggcgcgagcagctcggccacctggtcatgtcgacccactacgccggcacgctgaccgacgtgaccagcgtcgcgacgctcgccgggcagatgaccgcgaccaccggcgcgaccggccgggtgtcgctgtggaacgccgccaaccccgccaagccggtccgggtcggctcactgcccggcacggccgcggccaccaccgtggtgggtcgcccggaccggcccacggtcgcggtcttcgacgggagcccgacggcgacggtgtggaacgtgaccgatccggcccacccgtcccgggtcgccacgctgaccgacccggccgggatcgtggcgatgagcatcagccccgacggacacaccgtctcgaccagcaacctggccggcgactcccgactgtgggacatccgggacgccacgccgaccgcgctgaccaccctgaccggtgtctaccccctgaagttcagcccggacgggcggaccggcgtgaccagtggcgccagcgtggtgatctgggacctgaccgacccggcgcacccggtgcggggtgtcaccctggacccggccctcgccgacctcgccggcgcggccgtggacttcaatccccgggtgcccgcgttggccgtcgaatcgaaggtcgccaacgtgatgttcttcaacctgagcgacccggcaaagcccgtgatgagcggaagcacgccctactcgtacgacgacgcccggccgaccgcgatggggttctccccggacggttcgttgttcaccctcaccaactcggacggcgagaccgggttgtggtccttcgacacgagctcccaggggatgagtgtcaacagcaagctcgccgccctgaacagccccgacggtggggtccggtcgctgggcttcagttccgacggggcgacgctgaccacggcgagcgcccaccacgtcgcgaccatgtggagcacccggggccggtatccgagcagcccggtcgggtccatggagcgcccgttcggcggcacgctggtcggtctcgcctacgcgccggccgccggaccgctgttctccgcgggctacgcgggaacggcggtgccgtgggacgtgacggaccgcacccacccggtgcggggcgccaccttcccgctgctcaacggaaccgtggaggggctcgtgctgagcccggacggcaggaccctggtcgccgccggttccgacacctcggtgccgctggtcgacgtgtcccatccggaggcaccggtgccgctcagcgtgatcaaggaggagggcggcgcgatcaccgcgctcgccttcagcccggacggacacaccctggcgatcggccacagcgaggggcgggcctcgctgtggaacgtgaccgaccgacggcggccggttctgctccgcgcgatcaccatgcgccagtacgtgtgggcgctcgcgttcagcccggacggacacaccatggcggccggtgagggcagcaacatctcgctctgggaggtcaccgacccggcagccgccgagcagctctcgtcggtggtactcaaggagtacatcctctaccacgcgaccgccatcacgttcagtccggacagtcgcctgctcgccaccggcaccaccgcgcacacggtcatcatgtgggatgtcgcggacccggcccggccccgccagagcgcggtgctgggcgggcacacctgggagatcaccaatgtgatgttcagcccggacgggcagaccgtggcgtcggtcagctcggacggcctgacgatgctgtgggatgtcgccgacgccgtccgtccggtcccgttcgccttcctcaaaccggccgccccggagtacctcgccgccgcgttcagcccggacggccgtaccatcgtggtcggcggctccttcggcaaggcgccccagcacgcgacactctgggacaccggcgtcccgaagtcgctggccctcgacccggtcggcaacgcgtgcgagatcagcggccggggtctcaaccgcgacgaatggagccgctacgccccggagctcgactaccgcccgacctgctgaccacccgcgggcccggccggggccggcacctccagctcggcgaacagccgccgggcccgctccgcgtgcggacgggcccggtccgggtcgccggcgtcgaggaacgcggccgcgatgccgtcgtgcgcgcgggccatctcgtaccggtcgccgatctcctcggccagacccagcgcctgcgcgtgctgggcccgtgcctcgtcgccgtcaccggcggcccgcaacacctggcccaggtcgttgagcgcttccgcctcgctggcccggtccccgatccggcggtgcagcaccagcgcccggcgcagatgcccggccgcctcggccagccggtcctggcgggcgtgcaccgcggccagatcggagagcacgtacgcctcggcggtgcggtcgcccgagtggcggaccgcgccgaggctctgctccagccgggcggcggcccggtccagcgacgccggccggtgcggcagccgggccagcagggacagcacgtacgcctcgctgaaggtgtcgccgagcgacgcgtaccgctgcagcgccgcctcgaaccgctgcgtcgcgcccagcggatcccccagccgggcgtcgatcatcccgagccggaccagcgcgtcggcctgcccggcgccgtccccgagctcgccgtagagggtcagcgcccgctggaagtggtcggcggccgcccgatagtcgccgagcagccagtcgacgctgccgaggttccgctgcaccatggcctccgccgcgcggtcaccgagaccggcatagaggctcaaggcttgccggtacgcggtggccgcctcgtgcggacgacccagccggcgatgcagccgccccagatgggacagcgcccgtgcctgcgcatcccggtccccgatcgcccgggccgcggacaccgcgcacgccgtgatggtcgccgcctccgcgaccggcccgcccgcgtccagataccggaacagcgtgccggccagcgcgatggtctgcggatggaacccgtgcgccgtgccgtaggtgcacagcaccgccagattgggccgctcggcctcgatccagtcccgggccgcgtccggatcgccgggcgccccggcgccgtccgggtacagcgtggccatcgcctccgccgaccgcgccaggtagtggtcgaacagcccggtcagggccgcccgccgggccgcctcgctgtcgtgccggtcggcgagctcggccgcgtacgcccgcaacaggtcgtgcaggccgtaccggccgccccggccggcctgcgccaggctcgcccggaccagcacggcgagcagccgtcgcgcctccaccggatcagttccggtcagcgcggccaccgcgtccacgtgcacggtctcccccgggtgcagcccgagcagccggaacagtcgggccgcggcctccggcagattccggtacgaccaggagaacaccgcacgcacctcggcccgcgggtcacccgcgtccagcagatccagccgcagccgatgatcgcccaggtcggcgaccagctcggccagcggcacgtcggcacgatcggcggccagctcagccgcgatccgcagggccagtgggagccgggcgcacgcggccgccagactctcggccgcggacggctcctggtcgacgcgtacgccgacaagcttgcgcagcaaccgcagcgcatccggaaccggcagcagatccagattgacccgctgggcgccgtgtaccgcgaccatgccgggcagcgaatcacggctggtgaccagaaccagacaggagccggtgccgggtagcagcggccggacctgctccaccgacgacgcgttgtccagcagcaccagcatccggcggccggtcagctccgagcggtaccgcgcggcccgctcctcgataccgggcggaatctccgggccgcgcaccccgagcgcggtcaggaaaccggccagcgcatccgcgaccgccaccggctgctccgcgtcatagccgcgcaggttgatgtagagctggccgtccgggaacgcgtcccggacccggtgcgcccagcggaccgccagcgccgacttgccgacaccggcggtgccggagaccaacgccacggtcagcggcggctcggcgccgcccggcgacaccagcaaggcgtccagagccgccaattcgccggtacggccggtgaaggcgcgcacgtcggcgggcaactgggcggggaccggcggctccttctcccccggcctgtcggcggccttctcccccggccgttccatgagcctgtcgatcgcctgctccaccggccccaccagcgccggatcggccgtcaggatctgctcgtgcagccggcgcagcgccacccccgggtcgctgcccagctcgtcggcgagcgcccggcggatccgccgatactgctcgtcggcgtccgcctgccggccacaccggtacagcgtcaccatgaactgaccggcgagccgctcgtccagcggatgctcggccaccgcggccgacaacaccggcagcagctcggcatgccggcccagccgcaacagcacgtcggtgcggtccagctcggcgacgaaccgctcgcccagcagggtgcgccgcatcccgtccagccacggcgtgtccagcccggcgaacgggtcaccccgccacaatcccagcgcctgggtgaacaggccggccgcgacccggtcggcgccggcggcccggccctgcgccatcaggctccggaaccggtgcagatccaccgtttgcggctccacggtgagcagataaccacccggctcccggcggatctccacctcgggcgcgccggccaccgcccggcgcagccgggacaggtagctgtagagcgcgcccgccgcccgctgtggggcctgccggccccagacccggtcgaccagctggtccaccgagaccgggcgacccgcctccaccagcaggacaccgagcacacatcgctgccgggcgtgtcccaaatcgacggacacgccgtcgatccgggcctcgaccacaccgagcacgccgaactccgccgccaacggacccccgttcaaccaggagattcaagaaatcctcaaggacggtacgagtcttgcatgcttcgtacaaggtccgttcgcgagcattgaacacgttgcagggaggcaggtcgctctcgcccggttatggcagcgtaacgggggaatcgggacgccacagtgactcattcggcgcgagcgacctgccctgcaacgcgccgttgccggccttctccggtgcccccacggcccggccctgcccgcggaccgctgctccggtcaccctttcccggccgcccttctcggcccaccctgctgcttcacatacccctttcccagcccggcccgtcggcttggccccctcgttcggcgatttttgtcggggggtgggtctagcgtgcggggcatggagacagtgacctcgcgggacggcaccaccatcgccttcgaccgttacggcgacgggccgccggtggtcctcgtcggcggcgcctttcagcaccggtggatcgaccagcagaccgcccgcctcggtgagctgctggcccaggccggcctgagcgcgctgcactacgaccggcgcggccgcggcgacagcggcgacaccccgccctatgccgtggaccgcgagctggaggacatcgacgccctgctggaggcggccggcgggtccgcgatgctgttcggcatgtcgtccggggcggcccttgccctgcgcgccgccgccaccggccggcccgtggagcgggtggcggtctatgagccgccgttccgcgccggtgccgaccccgagacgacggcggcggtcatcgcggcggcccgcgaggggcgacgggcggacgcggtgcgcggcttcatgcgcctgaccgggatgcccgacgcgatgatcgaccaggtccagcagagcccgggctgggccggcctggaggcggtcgcgccgactctggcctacgacctgacgatcatgggtaacggcgacgtcccggtggaggtgctggccgcggtcaaggtgccggtgctcgccatggatggcggagccagcccgccgtgggccggcgaggccgccgccgcggtcgcgtccggggtcgccgacgggcgccggcagaccctgcccgaccagacccacggcgtcgacccggaggtgctggccccggctctgatcgatttctgccgctgacttcgcgctgcgcatgggctcatgccggcggcaactctgccaggtgacggctgtgccccagggccgaggccgtaacgattgtcatccaggcgttctctacctcgagggccggccggttcgcgctgtttcggtgagcggctgcccgggagaggttgtaccaggggccggcgtgcagggccgcagcgtggggcaccagatgctcatgctgcggcgaccttggcgggatcggtctcgccgggcgcctcggtctcgtatctgcggaaggtgccctttccggcgttcttggctcggtagagcgctgcgtcagcgtcctggagcagctggtcgagatcgtggccaccgccgtaacccacggcgatgccgatgctggcccgtacccggtacgtgcggtcggcgagcgtcatgggcataccgatggcgtccaggatccgctgagcggactcatcggcctgctccgccgcggcaagccccgtcagcagcaccacgaactcgtcgccgccgagccgggccgcggtgtcccccggtccgagtgcggccgcgaaccgaccggcgaccgtgaccagcaacgcatcaccggcggcatgccccagcgtgtcgttgaccagcttgaaaccgtcgaggtcgagaagtaggacggccgtacaccggccgtccggcgcggacgccagtgcgccgtccgccacggcctggaacgcggcgcggttcggcaggccggtcagaacgtcatggttggcctggtggtgcaggccggccatgagccggcgaatcgtgaccagcatgaggagctgtcgcagcatcgccatcgtgatggccgacagcagcagccacatgagaagcggcggaagtgtgccggtgcgcaggtacacccggatcacttcgacgacggcgatgatcgccggaacgtacggtatgaaaggccagatgccggagagggcacgccggcccgtgctgtcggccgagggcagtgccgtcctgctggagagcgcgatgagcagcgcagcgatgaggtagcccgcgcccgctccggtggcataccacggcgagccttcggcgcggttgtacaccgcgatgatggccgtggccgcgaacgtcccgaggccgccggcgaggaggcgcagcgcatatccgttcgcggtgggcgtggaacgtgacatcaggaccagagccaccgccgcgcccccgatttccagtgcggcggtcgtcaggaacatcaggcgcgtcggcgcgtcgagagccgctgccacctcggacagggccagctgccaagccagcaccagcagcgcgccgccgacggtagccacatcgataagaagtgtgagccgggccacaacgccggacagcggcggcgcgaccaacagcaacgcgacgagcgccaccgctgccgcgcccaccgacaggaggccggccacgtcgggcgttgcgggggtgcgggcccagatcgcttccatggtgtagagcacgtacgccacacccagcagaccggcggacagggctcctaccgcccaaccggcaagcagacggccacgctctcggcgagcgagccgcacgaatcccaccgtcgcatagaaccccgccagtgcgaccggaatacttcctgcgacgaggccgacggagtgcgagagctgctgtaccaccagttgcagcaccaggccgatgaccgcaatggctgctagccgaggccagatgcgaaaagtcatgagcaccctccgcggtccctatcgacatgacgccggcgaagctgagccgtcgccggctccgtcggcgaccgcacgagttcgtcagcgccgctgcggggccggcgtcatgaacatcgtctccgtcagtcgccgaccacgacggcccggtgggcgtatgcccattcggcgacgaagtctttggcttcggtcacccgcggctggctgagggccgcgtcgagggcgtcccgcagggcgctcatccccatcgcggtcatcgggatccggatgccgtcgtgttcccccacttccagggcgaacgggtacaccacctcgctggtggcctgcacccgcaccggcgggtgcccggcctgctgccagggcgtgacggcgtgctggtgattgctcatgatgagggtctcccctgttgtggcgggctgtccggccatgctgcgcggcgggtctataacgatcctgtcggccgtgacggcacgtcttactctcaggtcatgttgaccgccagcaagacgagcgtgtggcgtggccggtatcagatcgacgcggacgggcgtccggtggctgtctgggatccgtcgtggtggcgcaacggcggtgctttcgagatcgacgggcagcggttcgaggtgcgggccaacgggtggggcaccaagtatcgaatgtacgacgccgccggcaacgaggtggcactggtggagcgggcggggcggaagtactggtcggtgcaggccgacggacgtatgtacgaattccgtcgttcctcgttcttcggaaaccggcaggagttggtggtcggcggggagccggccggcgaggtgcggcgcaccggggcgtggtcgggcaacatcgaggccgatctgccgggcctgccgctgccgttgcagattttcgtggtcggcgtgcagatcgcgatctggcaggcacagcaggcgtcgagtagctgagccccggccggggtatgggagcggcatgcctgacctggacgacgagacgatcgcgtacgcccaccgcatgttcgacctggcccgcgccggggacaccggggagctgctggacaacgtcgcggccgggctgccggcgaacctgaccaacgacaagggtgacacgctgctgatcctggcggcgtatcaccagcacgcggacacggtggccgggctgctgcggcacggcgccgacccgaaccgggtgaacgaccgcggccagtcggcgctgtcggcagcggtgttccggcagagtgcccagacggtgcgggcgctgctcgcggccggcgccgacccgcacggcggcgccccgtcggcggtcgcgaccgccgaatacttcaagttgccggacatgaccgccctgctgcggggctgatcaggccactatttcggcacccgggcggcgataccgtccagcatgcactccaggcccaggcggaaggtctggtccgcgtccaggtgcgccgcgtcgcggacgaccgccgccagcgccgggaaccggccgctggcgaaggtccgcatcaggtagggcccggaggcgacctgccactgccgcttgtccatcccgctggcccgctcggcgcgccgctcggtgatctcccgccgcaccgcgccgatcacgtacgagttgaccgcctcgaccaccggcatcacgtcgtccacggtcaccgcacccatcgcggcgatgaccgcctcgccccgggccagcgcgtgcggccccagttgcggccgcccaccgagcaggtcggcgaaccactcgtgccgatgcgccgccgcccgggtctgctcggccatcgaccgcagcaccgcccgccagtcctcgccggccggccggatctcggcgtggaccgcgtccaccatcaggtcgagcagctcgtccttggtggcgaggtagccgtacagccgcatcggaccgacctccagcgcccccgcgaccttgcgcagcgacaccgcctccaacccgtccgcatccgccagccggatcgccgcaccgacgatccgttgcctgctcagcgggctcggcaccggccgatccggcggctcgggccgctcccacaccaacatgccgacgaccatacatcgtccgcctcgatacaccgtatcgccacattagggaagctcggaggagcgcgtctcgccgtgaggtgatcccggcaaggaacgggatccgagccggttcggacaatgccggatgcgggcgtggagccatcgatgaacaatcgccgtgcggcagcggtaccgctgtgacatcctgccccatgacgatcagctggcgtcggctcggtcagccggacttcccactcctgcgacgatggctcgaacaaccacacgtcgcccggtggtggaaccacgagaccactcccgaggcggtcgagcgcgacttcggaccggcggcccgcggcgagacgccgtccgaggacctgctcgccatgctcgacggcgggccggtcgggctggtacagcggtaccgcatcgccgacttccccgaatacatcgacgaactcgctccgcacgtcgatgtacccgccggttcgatgagcatcgactatctcatcggtgacccggcgctgatcggccacggcctgggcccccgcatcatcaccacgatcgtcgcgcggacctggctcgaccgtcccgatgcgacctgcgtcatcgtgccggtcgtggcggccaaccgggcttcctggcgagcgctggagaaggccggcctgcgccgggtcggtgcggggaacctcgtacccgacaacccgatcgacgatccctggcatttcatttatcgggtcgatcgcccctgacgcgcgggggggggtgtccctatgggtttgtcaatggggtgtcgagggccttggcccaggcgatgacgtggtcgatggcgtcgcgggtgaggccgatcgtcgggtcggcggtgatcaacagggtggggttggtgcgtgtggcggcccagctgcgagcttcgggtgtgtgcaggtcgtcgatccatgccgcgggccgttgctgggcgtatgcggcgatgagtgggatcttgtcgctggggtcgaagggtggggctggcatggtgatcacaggtagaggtgtgatgtgaagaagcggagcgagaagctggttggcttcgtcgttccagcttgtggcccatgcgatgtccaggacggtgctcgcttcggtgatccaggcgccgtgtgtggggttgatacgaacgggttcctcgtcctcggggaacaggtggtgctcggtgtagccgaccggtggctgagtggttccgtgggggttgaggacgccgtcgacgtcgagtagcagcaggggtcggctcattcggaagattctgcctggtgtggtcagccggtgatgaccgcaacgatcggccttggctggtaatcgaccttgtcgcggagcatggcgaataggacgtcgcagcgacggcgggccaggcagatcagggcggcgttgtggcgtttgccttgggctctcctgcggtcgtagtaggcgcggctgaccggatcagcgagggcggcgaacgcggttggtcgacgcgcgagcaaggtcccggcgatagacgttctccgaaatgtcggtgggtgtcggcagaatgccatgcatgagggcagatctgggtacggtcgtcatcaccggggcagcggggcgaatcggctcggtggtgcgtcgacatctgcgcgccgatgttcgccggctcgtgctggtcgaccgggttccgttgtccgtcgagtcgccggtggagcagacgatccggctggacctggcggacctggacgcggtggccgccgcgatggcgggtgcggacgccgtggtgcatctggccgggctgccggatgaggcgccgatggccgatctgctcgacagcaacgtgctgggcacctaccacgttctggaggccgcccgcaggcaccgggtggggcgggtggtgctggccggcagcaaccgcgtcaccggcttctacccggtcggccaggtcgtcacaccggacgaccccgtgcggccggacgggttctacggggtcagcaaggtggccgtcgaggcactcgggcgcctgtatgccgacaagttcgggctctcggtggtgtgcctgcgcatcggcagcttcgaggacgagcccaccgaggcgcggtatctggcgacgtggttgagcccacgggacggcgtcggtttcatccgggccgcgatcaccgcgcccgatgtgcacttcgtgaccgcctacgcggtctcggcgaacacccggaggttctgggacaccgcggccggagcccagatcggctatcagccggtggacaacgctgaaacgtacgccgcgcgagtgcccggctcggaggccaccaccgactccgcagccgtccagggcggcgcttacgccagccctgaatactcgctgcggcacgccgtcacgccgccgccgtcaggcgtgcgcggtgtcggggccgagcacgctggtcagagcaccggtgagcacggcgatgaacggttccggcgggggtgacccaaccggggcggcgagcgcggcggcgatgtacgggtggtctcctgccgcagcggcgtggcggagataggcgctctggcgtgcgacgtcggcggcggccacctcgttctggacgaacagcgcggtcaatccgccgaggagcgcgaacgcccgcagtttgcgggccggctcggcgggatggccgtcgaggacggcgaggacgtgctccagcaggtcgatcccgtgcggcccgagcgccgggcgggcgatgaccagggcgggcagccacgggtgccggcgcatgatgtcgcgggcctggtgggcgacggccagcaggtcggcctgccagtcgccgctcgcggccgacagccggtattcgccggccgtgctgtcgatcatcaggtccaggagatcgtcgcgggtggcgacgtagcgatacagcgaggccgccccggtaccgagcagggcggcgacgcggcgcatcgagacggcctccagcccctcgtggtcggccagccgcaccgcgaccgcggtgatctcggcgcggctgcgctcggccggcctcccggccgcggcacgttcggggcgcagccagatcaccggttcctgttgcccgaccacccaccggctcccttcgtgcgccctgtcgccgcctcccatcttcgcatacgatgttcgcgtacaccgttcgcaaacaaaccgagaggagcgacatgaccacgcagtacgcgatcaacggcggggtccggatcgccgtcgaggagctcggcggcgccggcggcgctccgctgctgctggtgatgggcctgggcacgtcacggttctggtggccggacggcctggtcaccgagctggtgcggcgcggcttccacgtcgccgcctacgaccagcgcgacgcggggcagtccacccgcctgcccgccgttcggcgtaccggcccgccgatcgcggcgctggtgcgccgatcgacgccggcgtacaccgcggaggacctcaccgatgacgcggtcgccgttctcgacaccctcggctggcaccgcgcacacctgttcggccattcgatgggcggtctcgtcgcccagcgcatcgcgatccgccatcccggccgggttctcaccatgacgagctccgccgcgatccccagcgacgtccgcggcctgcgcaccctgcgccatctgcgccttgcgccgttggtcaggttcgcccgcctgcaccaccccgccacgcccgacggcgacctgcgcctcgccgtggccatcgcccggatcctggccgcgcccggccaggacatgaccgaacgcgacgtccgcgagttcgtcaccagggaggccgcccaccacgtcgccagcttccgcgacgacgaggcccagagccgccagaccggcgcgacatggtccggcggcccactgcaccggatcaccgcaccgaccctggtcctgcacggcgagcgggacccgatcgtccgggtcggtgccgcccgcgccatcgccgcagccgtacccggcgcacgactgcgcatcattcccggcgccggccacttcctttcccgcgacctgtggaacgtttatgccgaggagatacacgccatcggcgggccctcggcatgcggctgaggtcgggcggtggccggcggggccgcgtcccggccgaggtccgcggcgaccctctcgacgcggcccgtccggtcagaacgcgatcagggccttgagcacctcacggtcgtccatcgcgcggtacgcggcgggcacctcctcgatcgacacggtgcggtcgaacaccttgcccgggttgacgctgccgtccaggatgcccggcagcagctcgtcgacgtaggcgcggaccggcgccggcccaccgttgagtgtgatgttgcggccgaacaggctggcccggcccaccggagcctcgtcgtactgcgggacgccgacccggctgatcaccccgcccgcacggacgatgccgacggcctggtcgtacgccggccggtgaccgaccgcctccaggaccttgagcgcgccgcctccggtgagctcgcggaccttggcgatgccctcctcgccccgctcggcgaccacgtccgtggcaccgaattcgacgccgaggtcggtgcgtgccttgtgccggcccatcagcacgatctgcccggcgccgagctgtttggcggacaggacggcgagcaggccgaccgcgccgtcgccgatcaccgcgaccgtgtcgcccggcgtcacctgggccttcttcgcggcgtggtacccggtgccgtaaacgtcggcgagcgtgagcagcgagggcagcagctccgagtcggccggcaccggcagtttcgccagggtgccgtcggcgagcggaacccggacgagttcggcctgggcgccggcgaagaagccggcttccgggtgggcgcacgcggtctgcacgccggcgcggcagaactcgcaggtgttgtcctggtaggagaacgacgcgacgaccaggtcgccggccttcaccgtggccacgtccgcgccggtctgctcgacgatgccgaggaactcgtggccgacctgccggccctgctcggcggcgggcatcgagtggtacgggtgcagatcgctgccgcagacgcaggaccgcacgacgcggacgaccgcgtcggtcggacgctgcggggccgggtcggcgacggtctcgacgcggacgtcaccggcgccgaacatgagagtggcacgcatgcctgtgatccttaacttccggcagattcgaccctttcacgatccagcaaaccagggccgggtgacaggtactgccggaacacctcaggacggcaggccggcgaggatctcgtcgacggtgagcgtggccacgccgatccgcgccaggtcggtcacccgctccgcggtgacctgcgagatcgcgtcgaccggcagcacggtgcggaagtcgcgctcgctggcctcgaacacggtggcccgggggcagttcggcaggttgcagccggccaccaccaccgtgtcgacgcccgcctcgcgcagccgttcctccagatcagtgcggtagaaggcgccccagcgcggtttgaacaacacgatttcggcggtacgcacggactgcgcccgccccgcgaggagttccgcggcgtccagggcgaacggtcccgagtcgccggtgacgcccggcagcagcgccgagcccgcggtgccgggcgcgaccagctgaccacccgccgccacgaacgcccggcgcggcgggtcgacgtcggcaccgccgggaacgtacagccgaatcatgtggacgatcggaaggccggcgcgccggaagccggcggcgagccggcgcaccgcgggcaggaccgccgtggtgccggggatcgcgccggccccgccctcggcgaagtcgacctggagatcgatggtgaccagtgcggcgttggcccagtgcggcgcgatgtaatcgaccgacatggatgtcatcctgtcatgccgtcccgggtgggtcaggcgcaggagatgcagtgccgggcgaacggacggacggcgagccgctcggcggcgatcggccggccacagccctcgcagacgccgtagccgcccgcgtccacccgggccagggcgtcgtcgacctcggcgatccgttgccgcgcggccgtcagcagcgcggtcagctgggcccgctcgaagccgatggtggcgccctccgggtcgtgctcgtcgtcggcgttggaatcccgggacgccgcgaagagcgcgtccaggtcaccggccagcgtcgccgcttccgcctcggcgtcctcccggagccgcaccagctcgtcccggaccatgctcgaaccctaccggctgtggcggcgccccatcgtccccacgtcccggaatcaccgcatgggctcagaacaggggctcaccgtccggccaggtgacgagctggctgcgggcggcgtagccgccgttcccgtcgccccggtagaaccacagcgtgccggtggtgtcccggccgatgaagtcctggttgccgtcgccgtccacgtcaccggccgcggcgatggccgggtagatctgccagtcggtgccgatctgtgtggccggcccgaagccgccccggccgtcgccccgcagcagccagagggcaccgtccgcagtgcggccgatcaggtccggggcgtccgcggcgtcgcgggcgaagtcgcccggggagaacagcagatcgtacgtgctccacgggacgcccgcggccgccgggatcgcgatcggagggccgtaaccaccggccgctgtgcccgggtatcgcgacaacgtgccctgccggtcgcggacgaccagatcgggttgaccgtcaccgtcgatgtcacccggagccagcagcgtctcggtgccgccgaatccggagcccgcccgaaccttggtgccgccggtgtaccgtccgttcgccgggtccgccggatagcgccacagcacgccgtcccggtcgacggcgaccagcgtggtgccctgccgcgcgacgtgggtgaggtaggagggggcccagccgtaaccgcgcttgcaggcgccggccagggtgccaccggcctggccggcatagtggtagagcagaccggccgcgtcgatccggaacagtcccgccgcgcccgggctcagcgcgccgcagtcggcccaggcggcgccgccgcgcagcagccggtggtcggagacggtcgcgtcctgcggcagtgcgtcaccgaccacctcgcggaagaagcgcgaggtgacgaagatgtagtcgagtttgcggccgtcgtggaaggtcggctcgccggaccggcagtgcccgctggtgcacccggacgggaagtggtccccgtccgtctcgtccacctcggtcatgtcgccgctgccctgctgggtgccgggcgagtagaacgcgtcggtggtcgtggtgccgggctgaccgttgaaatcgccgccgatgatcaccggaaggccggcggcctcccaggcccgggtctggtcggtgagcttgcgcgcgttgccctcccgcaaggccgcctcgttccagtagagatgtgcggtgcacgcccaggtgagacggttctgcacccagctcttgacgcacgggctcttgatcggctcctgctccgcgccgacggtcagcgtcaggatctgctcgccgaccttggtgccgcgcgcgaagaccgcctcgccgtaggcggatcccttgcacaccttccggccgctgatcaccgtgccggccggcaggcgctcggcgtacacgccggtgaagccggccggcagcttcgcggcgatgtcgtcgtactgatacctgcagacctcctcgaggaagaggtagtccgcgcgccagccgccggtcgcggcttgagcgacgacggtggcggtgcggtgcgcgtcgtcggcaccggtcccgtcggccacgcacatgttgccgcacaggttgtaggccacgaaacgcagcggcgccgcggtctccggctgcggcgcgtcggcgaccgcggccgacgtgccgcagccgagcccgacgacaaggacgagactgctcaccagcgcggcgagcctccgtgacatccccatgacactcctgatcagacaagcggttgagcgagcccgaaccataccgaggcggcgatggaacaccggttcagtggaggctgcctccattcattacggtagctattcatgagatccaaatcggcttcacatggggattcgcccggcggttgctcgccgcggcgatgatgtcgatcctggtgggtgtcgcggcgatggccgggctcaccggcgccgccaccgcggcgaccgccactccgcccggtaaccgggccaactacaccgtggtgctgatgcgcaacgccggcgccacgtcgttcgtccggctcgccgagtacagtctgcgcgccgacgggtcggcccgggcggactactgggcgtggaacagccagacacccgaggccagcgtcgcgtccgggttcaccaacgagggctgcggcaacagctgcccgatcctgaccaccgacggttttcagaaccccgcgcagcagcttttcggcacctggtccgtctccggcgacgatctgacgatctcctggacgagcggcaacccgcagaccgagcgctggaagttcaccaaccaggccaccgccaccagggtggagctggcaagccatccgaccgcgacgaacggctggggctggggcagccggatcagtttcggctccggcctgtccgcgcagcaggtgctcgccgcgaacaccacgctcagcggccggtacatccagaacgccgagggtgtgacgacgaacccgacgccgtggggcaccacctcgctcggcctgcgcccgggagccaccgtcaagctgtgcagcgccacctgcatcagcgtcggcaactccgccaacaaggcttacctcgccggcagcggcgccgaccgccggatgtactacaaccatgagcagttcgccgtgcacgccgacccgtgcatcgtgcacgggcacctgaagccggcgttgcaggtgctggacgacaacggcgccttccgcggcctgatcatggtggaggcgtcgctctacgccgacctcgggccgacgggcagcaccatcctcggcatctacgacctcaacgatttcaccagctgacgatccgccgggaacgtggccaccacgccgcgttcccggcgttcccggctttccacgatcaaagtcctttcccttgtgtacgtcgtcaacaccgtcgccgcgccgacgtcacggtggcgatgacgccgaggccacggcacgcgggcgggaaccgacggcccgaacggctcgggaactgttccacctaaccgcatcgccccattgccgcccacggccggacagcttttcggacaaccgcagcggtcggcctattcgtcaacgttctatacagcagacagtgccggtgcgcgatccgcaaaacgtaccgctcccgtcgcgtatcaggctgatgaccagctcaacggagcttccgatgtcgacgttcggacggacaaaccatgtggatatgacgtcgatgtccgcctttccctgctgtcggatactggtgaaaaatgaccggtagatttagacgttcatcgctttacaatccaagctgccagcagggacggtggccaactggactgtcccacgttctcgcgatgaggggctccacatgactgacggctggccgcggtgagaggccaccacgggccacaggtccggctccagctcctggggccgctgctcggctggcgcgacgacgagcaggtcagtctcggtccggtgcgccagcaggtggtcctcgccgtgctggccctgagcgccaaccggccgaccggccgcgccgagctgatcgaggcgatctggggcgagtccaccccggcgtacgcggtgaatctcgtccagaagtacgtgtccggtctgcgccgcgtgctggaaccggtgcggcccggccaccacccgtcgcaggtgctgtcctggaccgacgccggctacctcctgtcgttgcccgacggcggactcgacctcgaggagttcgagcgcggggtggcccgcgcgcgggccgctcgcgtcgagggtgacctcaaagcggcatcccgatcactgcacgaagctctggagctgtggcgcggtcccgcgctgaacggcttgtcgagcccgttgctggacgcggagcgcaaccgcctggccgagcggcggatcagcgcgctagaggagcgtatcgagatcgatctggctctgggcgagcaccgtgacctggccgaggaggcgggccgcctggtggcccagcaccctctgcgggaacggctgtgggccctgctcatgcgggcgttgtaccaggaaggacggcagggcgaagcgctcgcggccttccgcgaggcccgcgaccacctgagttcccagctcggcgtggagcccgcggcggaactgcaggccctgcacaagcggatcctcaacggtgatccggacctgctggcccccggcccgcgggtgccgcagacgggggccgtgccggcatcgcccggaccggccccgctccccgtccggccggcccggccggaaccccgacccgctcaactgccccacgggctgcccgagttcgtcggtcgccgggccgagttggaccgcctcgacgccctggccgccagcgggcagagcgtgatgatcgcggcgatcaccggcaccgccggtgtcggcaagacctcactggccgtgcagtgggcccaccgcatcagccatcggttccccgacggccagctgtacgtgaacctgcacggcttcgacccgtccgggtcggtcgcacggccggccgaggtgctgcgtggtctcctcgacgcgctcggggtcggtacgcagcagatcgagggtacggtcgatgagctggccgcccgttaccggagcctgctcgccggtatgcgcctgttgctggtgctggacaacgcccgcaacaccgagcaggtacaccccttgctgcccgggacgcccggctgcatggtcgtggtgaccagccgcagccggctctccggcctggtcgcggccggcgccgtcccggtgaccgtggagctgccgaccgccgaggaggccacggaactgctgagccgccggatcggtcccgagcgggtggccaccgagccgctggcggcggccgcggtggtcgcggcctgcgcccggctccccctggcgctggccctggtggcctcccgggccgcaccgcacccgcggtaccggctgtccgcgctggccgaggaactgcgcccggcccgggccgacgtgctggacgcgttcatcggcgagaccgagagcaccgacgcgcgggccgtcctgtcctggtcgtaccaccagctcagcgccccggcggcccggctgttccgactgctcgggctgcacccgggaccggacatcaccgcaccggccgcggccagcctcgccggggtcccggcgcgacaggcccgccggataatggccgaactgtccggcgcccacatgatcgaggagcacacacccggccgtttcaccttccacgacctcctgcgggcgtacgcggccgagcaggtcgaggaggaggaatcggtgaccgagcggcaggcggcgaccgaacggctgctcgaccactacctgcattcggcgcatgccgccgaccgcaccctgtatccgtaccgcacaccgatcgtcgtcgatcctcccgggccggacgccacggtgctggccttcgccggcccggacgaggcactggcctggttcaccgccgaacaaccggtgctgctgaacgcgatcgcccatgccaccggagccggattcaccgcgtacacgagccgcctcacctggacggtcaccgcgttcctcaactaccagggccagttccacagctgggcccgttgcctgcgggccgccctgctcgccagccgccagctcggcgaccgggccggcgtggcgcaggcgcatcagctgctcaacatcgcctgccgtcacctcggcctgatcgcggaggccgacacccacgcggagcgggcgctgcacctgttcgaccagctcggtgacaggtcccggcagggccggctgctgctcgacatcgcccgtggactggaacaccggggcgagtacgagcaggcgttgcggcgggccacccgggccctgtgccagttccacgaggccggcgaccggatgggtaaggccgacgcgctgagctgggtcggctggtactacagccggctcggcgaccacgacgcggcgatgcgccactgccacgacgcgctgcgcctgcaccgcgagggcaactggcccggccaggccgacacctgggccatcctcggcaacgcccatcaccacctcggccactacgacgaggcgctcgactcctatgcgcaggcgctcgcccggtggggtgagctcggtgaccgctacgaggtggcgatcaccctgcagcgcctcggcgacacccagcaggcatccggtcgcatcgaccaggcccggagccgatgggagcaggctcgcacgatcttggaggagctcggccaccccgacgccgtgctcctccaggcacggttggacgctcacggcgccggtggcgccgctaacgaaaggtgagaaagtgtcgcaggaagactcggagaaggacaccgtgaccaggcgcggccggcgggccgcggtcgtcatcctgggtggcctcgccgcaggagcggtcctgagcggcggggccgccgcggccgacccggcgccgtccatccacgaccagttccagtcggccttcgtcgcggggcccgcgcagagcgacgacggcctcaccgtccagatcgttctgggggactaacggctgtgggtaccgaactgccgctggtgagcaaggacgtccctgccaccccggtggggctcgcccacccggatgccgggcaacgggcgcaatggccggtggtgctggtggcgatgccgttcctggagaccggctggccctccattcagatcggcctgctcgcggcgatcctgcggcagcacggctacccggcgcagaccctgcacgggaacctcgacttcgccgcccggctgggagccgagtattaccacctcctggccgggcggcgggcccggatggtcgcggactggctgttctcggtggaggcgttcgggtccaccgccccggacccgaacggcaagctgctggacgactacgccgccgagttggcggagctggggggcgccgacgagtcgacgtggcgcgatcggctgctgcgggtccggcacgaggacgcgccggcctacctcgacgcgctcgccgccgacccggtcttccacggcgcccgggcggtcggcttcaccaccacgttccagcagaacaccgcgtccttcgccctggcccgccggctcaagcagcgctaccccggcctggtcaccatcttcggcggcgccaacttcgacggcgagatgggcccggaatgggtccgcgcggtgggctgcatcgacctggcagtggtcggggaggccgatgccgccctcccccggctgctggactgcctggtcgccggggccagccccggcgccgtcccgggtgtggtgcaccgggacggcggcgacgtcgtggtcacgccaccggccccgccgttacgccacctggacgaccagccgctgccggactacaccgagtatttcgagcgggccggccggctcggcgtgctgccccgtaccggcccgagccccgtaccgattcccttcgagaccgctcgcggctgctggtggggcgagaagcaccactgcaccttctgcgggctcaacggctccagcatgcagttccggtcgaagtccccgcagcgggtggccgacgaactggtcgcccaggcccgccggtaccgcagcttccggttccacggcgtggacaacatcgtcgacatggcctatctgtcggacctgttcccggtgctcgcgcgggccggcgtcaccttggacatcttctacgaggtcaaggcgaacctgaaccgcagtcaggtccgcgcgttggcccagggcggggtgaccgggatccaaccgggcatcgaatcgttgagctcgaacgtcctgcggctgatgaacaagggggtccgcgccgcgcagaacgtcaacctgctgcgctgggccgcctactacggcgtcgggtgcggctggaacatcctctggggcttcccgggcgagaccgaggaggactaccgcgaccaggccgcggtgctgccgcacctggtgcacctcgccccgccgtccagcgccgggcggctgtggatcgagcggttcagcccgctgttcaccgcatcgccgacgaagaccccggaacgggcgtacacctatgtctaccccgacgaggtggacctgcgccggaccgcctacttcttcgagtacgacctgcccggcgcgctgcccgagcacgcctacgacggcgtacgccaaggggtggccgactgggtcgcggcctgggacggcggcaaccggccgacgctgaccttctggtcgtcgccgggagtgatccagatctatgacggccggcgcccgggtaccgagggcacctacacgttcgaggggccgatcgccgatctgtacacgctgtgcagcgaccggccgatcggtgctgccgcggcccacgaacggctgggcgggcgcctgtccccggacgagatccgcgaggcgttcgacgagttccgccagcgcggcctgatgttcctggacgagtcgctcgccctgtccctggcactgccggccggcccgccacgctgacctgacggccttccatctcctctgccggcccccggttcctccgtacggacgaaccgggggccgccttgtgcccgcagcctgttccagtctgagttcccggccggttccagcggtccttcctgcgggtgttccaggggtaccccagacgatcggggtgcggcggtcgacaacggttccgcaccggaacgagccgatcgcgggcacgagcgataagtcgaggtgagatgcatgacagaccatgaggtcggcattctggcgatcggcgcggggccggccaatctggctctcgcagtagcgcttgaggactccggcccggccgatctggccggcagcacgatgctgttggaacagagcccggacatcaaatggcagcgcaacctgctgatgccgtgggcccgcagccaggtgtcgttcctcaaggacctggtgacgctgcgcaacccgcgcagccggttctcgttcctcaacttcctgcacgagagcggccgcctgaacgagttcgtcaacatggggaccttccacccgttccggtgggagttgtccgactatctgcagtgggcggcgtccagcctggagcgcgtacgcatccgctacaacgcgcgggcgtcggcgatcgaggcgaccgtcgccgccgacggctcgatcgccggctggcaggtcaccctgaccgacggcgacacgatccgctgccgcgacctggtcatcgggggcggacgagacccgcatattccggaggtcttcagcacgctcccggccgatcgggtcatccacagcaccaagttccagagccggatcggccagatccccgacgaccggcccgtccgggcggtggtcgtcggtggagcccagagctcggccgagatgttctacgccctgcaccagaacctgccgatgtgccagtcgacctgggtgatccgctcggtcgggctgcagaactaccagaccagcaagttcgtcaacgaactgttcttcccgtcgttcgtcgacgagttctactccagcgcaccggagacccgtgcccagatcctcgacgagatgcgcctgaccaactacgccgggctcgccccgccgttcctcgacgagctctacacgatgcagtatcagcagaagttcgtcggaccgcaacgctcgtcgatccgcccgatgtgcgaggtcgtcggggccaccatggacggcgaggacgtggtgctggacctgcgcgaccggaccagcggcaagaccgagccgctgcgctgcgacgtggtactgctgggcaccgggtacgaccagcggatgccccggatgatgcgggacctggccgaccggatcggcctggacagcgtcacggtcagccgctcctaccgggtcgacatcggcgactcggcgtggggcgcgctgtatctgcagggcttcaacgagcagacgcacggcatcgccgattcgctgatcagcgtgctggcccaccgctcgcaggacatcctcgaggacctgctggcccgccgcgccgagcagacggtcgcctgatggccgagcggctgatgatcgtcgcgcccggcccgaccgccaacggtgatctgcatctgggccatctggccgggccgttcctggccgccgacatctgcacccggtacgcccgggccgtcggccgggacgtgctgttcggtaccgggatccactcgacccagaactacatcgtcaccacggcccggcgactggacgaggcaccggaggagctgcgcgagcgcgcggcggggctggtccgcgaaagcctcgccacgctgcgggtacaggccgacgggttcgtcacgttcgacgaccggtacgtcaagacggtcatcgcgttcttcgagcgtctgcacagcctgggcaaactgcggctacggccggtccgcttcccgtacgtggcccgcaccggtgaatacctcaccgacgcgtacgtccgcggcagctgcccggtgtgcctcgccgacggctgcgcgggtctgtgcgagagctgcgggacctgggtggcctccggcgacctgatcgatccgcggtccaccctcgaccccggcgacgtcgtggagctgcgcgaggcgagcgtcctggtcctgccggtcgaggagtaccgggcggggctgaccgcgtacttcgagaagcacggacccacgatgcggccacggctggcccggatgatggaggagatgctgtcccggccgttgccggactatccggtcacgctgccgatctcctggggcatcgaggcgccgttccccgaggtcgccgggcaggtcatctactccgacgccgagacgatcgcctggagcatgcggtgcaccgcgttggcggcggaggcgcggggcgagataccgaccggcgaggacgagttgtgggacgccggcgccgacggccgggtcgtctacttcttcggctcggacgccacctacgcgttcgtggtggtgggcaccgcgatgctgctggcgctgggcggatacgttctgcccgagcagttcatcaccaacgagttctacgagctggacagcgacaagttctccaccagccgcggacatctggtgaccggccgggagctggccgccgaggtcccgcgcgacctcatccgcttctacctggcctcgaccgggccggagttccagcgcaccaacttcacccgctccgccatggaccgggtgaccgggcaacggctggtcgagccgtggaaccgggtcgcccggagagtcaacgccctggccggacgcgggccgctgccggtgtcgcaggcctcccgggatcgggcgttgctgatgatgcgacggttcggcggggatctcgcgccgcgccggttcagcatcagcgcggccgcgttcaccctgaccgagcagctgtcccggctggaccggtgggaggccggcgcggacgacgccggcgacttctgccacgaggtcgagatgttcctgcggtgcgccgcgccgatcctggtcgatctggcggagcaggcgttgccggacaccaccattccggaccggccgcgggccacccggatcatgccccggtcgatgccgctgctcgccctgtcggcggcgtgacgatcgtggcccggacccgccgggtgctcgtcgtcggtgccggggtgaccggtctactgaccgcggtcgcctgtgcccgcgccggataccgggtgacggtgctggaccgtggcggcgcccccgatcccggggccgcctcgtacgaccagcaccgcgcgttccgggcgttcatcgccggcgacccgcaggccaccgggcagctgctcacggctcgccgtcgctggcgggaactggaggcgctgctcggcggcaccctgttccgccgggtcggtgtggtcaccagcaggccacgcgaccaggtggacgcgctggccgccgaggcgaccgcggccggcgccgcggtcgaggtggtcgacccgggtgaactgccgcacatggtccttccggccggctcggtgggtctgaaggaacacgacgccggggtgctgctcgccgcccgggtgctgcgcgccgcggcccgctggctcgccgggcaggacaccgtgcagctgtgcccgggccagaccgtctccacggtggacacgcagaccggccgggtgcggctcgcctccgggcgggtcctcggcgccgatctgatcctggtggcggccggcgcctggacccgcgacctggtcgacagcccggtggtgctgtaccggcagacgatggtgtacctgcgcccgccggacgacctgcggcactggtggaacggtgccccggcggccggggggctggggccggaccggcgggcctggctggtgccctccggtgccgggacgctgctcaagctcagcacggatgcggtgtgccgggtggtgagcaccgtccggccggacgacccggcgccccggtggacgcagcgggtcctcgccgcccggatcgtgcgcgacgcaggccggtacaccgtcgtcggcgtgaaggactgccactacgccgcggcggcggccggcggcggggccctgctcgtccgagccggcccgaccgtgtggtcacgcgccgcgtgcgggggcagcggcttctccacggcgccgctggtcgccgaccgcatcgtgcaggccctgagcgaggccctgtgagagacccgcgaacaagtcagacaggagcgcacccgtgagcgacaacccacaaccgggagtcatcgccaccctgcgaatcacccccaccccggtccgacatctcctcaccggtgtgttcatcaaccagctcggtgcgttcgtccagaccttcctggtgctgtatctggcgttccgcgggcagtcggcgggtaccgccgccctgtgcctggccgcttacagcgtcggctccatcttcgggacgatggtcggcggcgagctgacccaccgcgtcggcgcgcggctgaccatcgtcaccgcgatggccgtcgccggcccgacggtgtgggtgatcccgtgggtcacccacaccggagtcgtggccgcgctgatggtcgtggtggcgctggcgggcctggcaacccaggcgtaccggccggccgccgcggtgatgatcagcgatctgatgccggaggaacaccaggtgatggcgttctcgatgatgcggaccgcgctgaatctgggagccgccctcgcgccgctcatagccgccgggctgatcctcgtcgactgggacctgctctactggttcgacggcgccaccgcgctgctgtacgcggcgttcgcgttcttcgtactcccccgggccgtcggcctgacaccggacagcgagccggagaccgatgcggcaccgaaagccaccggccgcgaggtctacgccctgctggtacgtgaccggaagttcctgtgctacctggccgcggtcttcctcggcacgatcgcctacacccagtcgaccagtgccctgcccctggcgatcgtggccgagcactacccggccgccctgtacagcgcggtcctgaccgtatcgtcgctggtcgtcatcctcgcccagctcaagatcaccacgtacgtcacccggctgccgaagaccgtggccgtgggcctcgggcacctgctcgactcgatcgggctggcggtgttcgtcctggccgcctggtggggcgggatcttcatcatcggcgtcgtgctgtccgtgggcggcctgatgatcgcggggccgagcatgttcgcccaccctgccacgttccaccccgtcgtgaaggcccggtacatcgccaccatgcagtcggtcgccgggctggccgccacgatcgggccgctgttcggagtcctcacctggcacgcgctgggcagcccgttctggctgctgtgcgccttcatcaacggcatcgccggtgtcctcgccgtccttgcgctgcgccgcacggccgaaccggttcccgcctccgcgaccgagaccgcaggagagacctcatgaacgtccagcccgggaccggccggccggtggtggtcgtcggctacgtcggcgtcaccctggccgctgtcgcccgcttccagcctgccggttcggtcgtctatgtcgaggaacccgacgtcatccgcaagcgtgccgtccgcgcgcacctcgacggcgtcccgttcgtccgcgacctgatcgcctgggagtacctgcggccgggagcggccgacgaattcttcgacgcccatcccggcctggacccggcatcggtcatcccggccatcgaatacgccaccccgttcgccgcccgcctcagcgaacgctacggccttcccggcgccggcagcggtgctgccgcgatcatgcgggacaagatcatgctgcgggaggtgacccgggcggcggggatcgtcaacccagccagcgccgaggtcgccggaccggacgacgtggcggcgttcctggccgggcgaaccgggccggtggtgctcaagccggccaaccgccaggcctcggtgggcacggaggtgatccacgatacgggtgacgtcgcggcggcctgggagcgctgtggccgacaggacgagggcatcttcgtgcccgaccggccgatggacgtgcgcatgctggtcgaggagtacgtcgccggcgacgagtacagcgtcgagatgctcgtccgcgacggcgtaccactgttcaccaacgtgaccggcaagcggctgtacccgggaccacgaccggtggagctggcccacatcgttccggcggacattccccgtgagctcgccgcgctgctcggctcgcacaccaccgacgtcgtcgcggcgaccggcttcggcaccggggccgtgcactgcgaatggatcgtctcgcagggcacgccgtatctggtggagtgcgccggccggctgcccggggacgggatcgtcgacctcatcgaagccgcgtatccgatggacctgctgcgctgctactacgccatgatgagcggggccgacgtcacggccggcctgccgcagcgggcgaccggcggggccgcggtgcacttcctgaccgccacgcccggtctggtcgaacaggtcagcggggtcgaggaggcccgcgccgtcgacggggtgctcctggtccaggtcaccgtcgagccggggcagctgtcccccgccgtgcgcagctcctgggaccgggccggcatcgtcatggccaccggcgccgacgccggccaggcgctacggcgggcgcggaccgcagccgatctcgtccgcatcgacacccgcccggcaacggaccggggcacgctgctggtcatcggcagcggcctgaaggtgtatcgcgagtacctgatccgaccgatccggcgccgcgccgaggaggccggcctcgacatggtgctggtcaacaacctgcggccgacctggcagagcgagtatttcgacgagatcgtggtcgccgacgtgttcgacacccggacgatgcgcgaggccgtcgaccggatcgccgcgcgccgccgcatcgtggcgctgatgtgctgggacgagccgctcgtgctcgacgccggcctgatcgccgccgagctcggggtgcccggactgtccgaggccggcgtacagggctgccgcgacaagcaacggacccgcgccgagctgaccgcggccggactgcaccagccggccttcgggctcacccacaccgtcgaggaggcccgcgcgaccgccgcgcggatcgggtacccggtggtgctcaagccccgcgcgatgggcgccagcatcggcgtggtgctggccgccgacgagtccgaactggacgacggcttccgggtcgcgctgtcggcgagcgaggtggatcccggaccgtaccgggcctgtgtgatcgtcgagcagtacgcccgcggtcccgagatcagcgtcgacggcgccgtgcacaagggcgagtacctgccgatgttcgtggctcgcaagcagagcggcgaggaaccgtacttcgaggagaccggccatctggtcgacgccgccgacccgctgctggccgaccgcgacctgatgcaggtgctcacccgcgcgcaccgggcgctcggcgtcgaggacggcatcacccacaccgagctgcgcctgacaccccaagggccgttgatcatcgaggtgaacggccggctcggcggcgacctgatcccgttcctgggccggaccgccaccggcatcgaaccgggtgaggtgctcttcgacgtggcgaccgggcagcggccgcacctgacggcgacccgccggatggtggccggcatccggttcggctaccccgaacaggactgcgtcctgcggtcgatcaccgtcccggacgcggcgcccgggttggtcgcggcggcaccgatggccgaacccggcgccctgctgcgcctgccgccaggcggttacctggcgcggcactcgttcgtggtgtgtgcggccgacgacaccgcgacctgcctcgaccggctcgccgcggcggcggccctggtgcatctcaccggcgacccggtcgggccgccggacgggcagaccccgttcgccatgccggccggtctgctcgacgtcgactccgaggagctgtgaacacatgaccccgaccacgctctccgcggacgatgtcctcgaccgcgccaaggctctcgccccgctgctgcgggagcgggcggccgagatcgaacaggcccgcaccctgcccgccgacgtcgtcgagctgctgcgcggcaccggcgtgttccggatgtgtttcggcgaggactggggcggcccgcagctcacctccatgcagcagacccaggtggccgaggccttggcgtacggtgacgcctccgccgcctggtgcggcatcatcggcgccaacaccggcctcctcagcaatttcctggaacgcgcggtcgccgagaagatctatccgacgctggacaccatcacggcgggtgtcctggctcccgccgggcacgcggagcgggtaccgggcgggtaccggctgtccggccggtggtcgttcggcagcggggtgaaccacagcgactgggtgatgtcgggcgccttcgtcttccaggacggcgaaccgtacgccagccccgacggcagcaacccgcacgagtcacggcagttcctggtcccccgatccgacgtccaggtcctggacaactgggacaccaccggactgtgcggcagcggcagcagcgactacaccatgaccgacgtttacgtccccgaggagcacaccctcaccttcgacaccgtcaagggcacccccggccccctcgcccagcccgactcgttcatgcgcagcctgtgcggggttcccctcggggtggcccgcgccgcgctggaccacgcccgcgagatctcactgcgacggaccgaccggatgaccgggaccgcctgggccgacagcttccgcgtccaggtcacgctggccgagtgcgaggccgagtacaacgccgcccgcgccggcgtctacacggccatgacccggcaatgggaggtcctgtcggccggcggcaccctcgacgatctcacgctcgacgagcgggcggcgtccccgatcgcctggctgcacgccttccgcacctcacgccgggtggtcggccgcctgtacgacctgctccaggcctggtcgatcaaccgcagctcaccgatggaccggtggctgcgcgacaccaccaccatgtgccagaacctcagtgcccaggacgcgatcctcgagtccgccggagcctatctgctgggccggccgccgagattccgcatctgcctcggcatcgtccgctgaaacccgacctaggagtaccgccatgaccacgacgcaggtgccggtcatctcaccaccccggacggcagccgaaatcctcgaccgcgcgaaagccctggcccccgtactgcgcgagcgggcggccgagatcgaaaaggcccgcacactgcccgccgacgtcgtcgagctgctgcgcggcaccggcgtcttccggatgtgtttcggcccggagcgcgaaggccccgggctcacctccatggagcagattcagatcatcgaggccctggcgtacggtgacgcctcggccgcctggtgtgcggtgatcggggcgaacagcggcatctacagccgcttcctggacccgggcgtggcgcgcgggatgttctccagcatcgacatggtcgtggccggcctgctccagccgtccggccgggccgaacgggtaccgggcgggtaccggctgtccggccggtggtcgttcggcagcggggtgaaccacagcgactgggtgatgtcgggcgccttcgtcttccaggacggcgaaccgtacgccagccccgacggcagcaacccgcacgagtcacggcagttcctggtcccccgatccgacgtccaggtcctggacaactgggacaccaccggactgtgcggcagcggcagcagcgactacaccatgaccgacgtctacgtccccgaggagcacaccctcaccttcgacaccgtcaagggcacccccggccccctcgcccagcccgactcgttcacccggaccatgtgcggggttcccctcggggtggcccgcgccgcgctggaccacgcccgcgagatctcactgcgacggaccgaccggatgaccgggaccgcctgggccgacagcttccgcgtccaggtcaccctggccgagtgcgaggccgagtacaacgccgcccgcgccggcgtctacacggccatgacccggcaatgggaggtcctgtcggccggcggcaccctcgacgacctgacccggtgggaacgagccgcctgccccacctcgtgggtgcacgcgttccgcacctcccggcgcatcgtcgatcgcctgtacgacctgctccaggcctggtcgatcaaccgcagctcaccgatggaccggtggctgcgcgacaccaccaccatgtgccagcacctgatcgcacaggatcgcatcctccagtccgccggggcgtacctgctcgactcgaggcccgagttcggcatctgcctcggcatcgtctgaggaggcgacgatgagcagcggtctgatcacactggtgaaccccaacaaggtgttccccccgattgccccgtacgggctggacgtgctgaccaccgccctggagcaggcggggttcgacgtcgacgtactcgacctgacgttccgccgggacgagtggaagtcgttcctggcggaatacttcgcggaacgcaccccactgctggtcggggtgtcggtgcggaacaccgacacggtgtacgccctcgagcagcgcccgttcgtcggtgagcacaaggagatcatcaccgaggtgatgcggctgtccgacgcgcccctggtctgcggcggcatcggcttctcgacgatgccgttcgccctcgtggagtacttcggcgtcgacttcggggtcaagggccccggcgagcagatcctggtcgacctggccgacgccgtcgccaccggccgcgatcccgccaccgtgcccggcctgatccgcaacacgcccgagggcgtcacccgggtgccgccgccggtgctacgcctgccgcacggcctgtcggcaccggtgtcaccgacggccgacggcgaggaccgggtgtggcaggtcgagcggtccggttcctaccggcgccggtcgggccagccgtacaaggtggacaatctgcagcactaccacgggggcggcctgggcagcatcctgaccaagaacggctgcacctatcggtgtgcgcactgcgtcgagccgaatgcgaagggcaatcggttcggccggcgggacgtcgccgccgtcgtcgacgagatgcagtcgctcaccgagcagggcgtgctcgacctgcacaccaccgacagcgagttcaacctgtcgatcgcccatgccaagagcgtgctgcgcgagatcgtgcggcgcaagcgggccgactcgggcaacccgctcaacgacctgcggttgtgggtctactgccagccctcacccttcgacgaggagttcgccgggctgctcgccgaggccggttgccagggcgtgaacgtcggctccgaccacatccgcgccgacctgctgcagggctggaaggtcaccggcggcggcagcacgtactacacgttcgccgataccgaacggctggtccgcctgtgccacgagaacggcctgaagaccatggtcgaggcgctgttcgggatgcccggcgagacgatggagacgatgcgcgagtgcgtcgatgccttcatggccctggacgccaccgtcaccggcttctcactcgggctgcggctgttcccgtacattccgctcggggtcgatctcgctcagcagtgcgacggggtacgcaccgcgcccgggctgcagtccaacacggcgaccgaaccgatcgtgctcaaaccgctggccgcctgttccgggccggccgagtacgaacgccagttcatgttcgatgaacacggcgacttccggctggtctgctatctctcgccgggcctggccgaggacgtcaccaacccgtccgtgcagtgggaacggactgtcgaacggctctgggatctcgtcgaccccgccgagcaccaccgggtcatgctgccgacactcggcggcaccagcgagatcgacaacaactacgccgacaacccgttcctgaccagcctcagtcagctggggtacaccggagcgttctggtcgcactggcgcgaccgggaggcgatcatgcgcgaggcccgcgaggccggaatcctcccgacacccgaggccgggcgacgatgaccagcgaacggagcagaactgtgaccggagcggaaagcggcggcgtgcaggttcgccgccaggaacccgacgacctcgcccgcgcgcacgggctggacctcaagctgttgcagccgtggcccggcgtggacacgccgttcgagggtgcctggtgcgtgctgcgcccgggcgacgtgaccgacacccactcccatcccgaacgggagatcttcatcgggatggccggtcgcggcgtcctggtcaccgcgtccggtgaacggcacagcatcgtggccggtgacctgctgacgatgcggcccgggctggaacaccatgtggagaacgacagtgaccaggacttctcctactacgcgatctggtgggacggcgcaacggcggccgccttcctcgaccgtgccgcccagccgtcatgatcgactacgacgggcggcggttccgtaagccgggcgacgccgacggcaccgtcgccacctatcaccaacagggcgacgtggtctgggccgacttctccggcggtgaggtgcgccgcggctcgatcaccggcatccggcagagcgacggaacgctgcacctgggctacaccatggtgctgaacagcggcgaggtgatctgcggacgcgcgctgaacacgccgatcgccaccggcgacggcccgctgcggctgcgcgagaactgggaacggtacggcccccacgccgccaccggcgtctcgtacctcgaagaggtggggtgagtgcccaccgtcagcgccgccgcttggcgcgccctggaaaccggcgtccgcggtcgggtcctgcgtccggatcagtccgggttccgggagtccagcacgccgttcaacacccggcatgcggccaccgtgccggccgcggtggtccgcgcggccgacgtcgccgatcttcggctggtgctggcctgggcccgcgacaccgccctgccggtcgtcgcccgcggcggcggccacagctacggcggttactcgaccggtagcgggctcgtcatcgacctcagcgcgctggacgaggtgacggtggacgcctccaccggccgcgtgacgatccagggcggcgtacgtaccgccggagtgtacgccgctctcgaaccgcacggcatcgccttcccgctcggcaacggcgcatcggtgggcgtcaccgggctcgcgctcggcggcggcacagccgcgacctcgcgcgcgttcgggctcaccgccgacacgatggtgagcaccaccctgctgaccgccgacggtcggctgctgacctgcgacgccacccagaatgccgacctgtactgggcctgccgcgggggtggcggcgggaacttcggcatcaacgtgtcgaccaccttccaggccgcccaggtctccgacgtctccaccttcctgctgctgtgggaacgcgccgcggctgagaaggtgctggaggtcatgcaggaggtgcagcggcgtgcgccgcgggagttctcggcccggctgggtgtcgccgcgaccgccggatccgacccggtggtgtccgcgatcgggttgcacctcggcccggcgggcgagcttcgcgaactgctcgacccggtcctggcggtggcccgcccggtccgggcggacatcgccgaccggacgttctggcaggcgcagagctacctgctgcacgacacgtcggccgaggcgttcgcggtgaagacgtccttcgtccgggacccgctgcccgccgacgcgatcgaggtgctgctttccgccgtggaccgctggccgaccagcaccaacccggacggcggcggcgtcgcactgttcgcctacggcggcgccgtcaacgacgtcgcgccggtcgataccgcgtacgtgcaccgcgagggtctgttcctgctcagcatggacacgtcctggaccgacggggacgatccggccacggtcggcgccggcctgcggtggctcgccggcctgcgcgaggcgatgacaccgtacgtcaccggcggcgcctaccagaatttcatcgacccggacctgccggactggcgcaccgcgtactacggggtcaactacccccggctcgtggagatcaagaatcaggtcgacccggaccgggtgttcagcttcccgcaggccatcggcacttgacgggggttgacacctcacccgccgggaggcgctcgggcaagtcagtggggttgaaccaggtccaagcgggacggcgcccccagctgaagtcaggaagtggatcttctcccgtattggtgccacagtcgccggccggcctgagagaacccgactggatcaaggagtgtgttcaccgcagcacctgcgggacaaccaccgcgtgtgccagcaccctcgttctctggttctcggaaggaactcgcatgcgcacccggatttcgattctcgccgtcgctggagccaccatggtgagcctggtcggattcgctggtgcggcaagcgccgcaccggctgccgcgaccaccgcgaaaccggcgaaggcctgctccacggccaccgccgcggctctgcaggcggccgcgaagatgccggccggctggaagatcaagaagagcagcatcaactgctggaacaacacccttgccaaggccgagttcaccgcgcccaccgtcgagcagcagggcgacggcatgacggtcttcaagtaccggaccggcaccaagaagtgggtcaagatcaccgagggcagcagcatcgactgcgccgacctcggtatcaagaagcacgccgcccacccttcctggtgcatccccgcctgaacgacgggcccggccgggctgaacccgcctgaggtggctcctgatcagaccctcacccactgggccgcgcccgggcgatgcggcacttcaccgtcatcgtccgggccggtcctggtctgcggcgggctggtcgatccgacggccgggtgtaggcccggcgttgccgggtatgggtgtctgtccggaagggcacacagtcggctgcccggacagaacgggcggaaggcgaaccatggcggctgaactacgggcagacgaaatcgccgagatcggcaaggcgatcgcgcgttcaggtctgtaccttcagttcgtcccccagccgacagcgctggagacgtgctggtacacggtcggcttgacccggtacgggcatcctgagctgattctgttcgggttgccgccggacatctcccggcccgccctacaggccgttgccgaggagatcatcgccggccggcgcgtgctcacggcaggtcagcgtgccggcgacattctcgagggccaccaggtcgagctcgtcgcggtgaccgagccggatcgccacctgcccgttgccgcgcagttctacgaggccacgggtgccgtcgtggaggcgctgcagatcgtctggccggatcgccaccaccgctggccgtggcaacccggcacccgcgtggacgacatgccggtactcggccggccgacctcagcaggttgaccaggtgtcgcggtctgccgcgtcaggacaggtggtcgggttcacgccgcgcggcgtggaccgcgcgtgcggtgtcttcttccacgaggtcggtgttgatgtgcgcggcggccgtcgctcccgcggccgccgcggtccccacctgggcagccgtgtccgagacgttgcccgccagccacacgccggcgaccgcgctgtggccggtggcatccacccggaagcactcgccggtgccggactcctcctcgcacggcaccaggcccaacggccgcaggaaccgcgccgccacgaccaggcggggtgacaccaccaggacggcccggtcgacgacggtgccgtcactcatccgcaccccggcgagccggtcgtcggccacctccaacgccgacaccttccccgcctggacccggaccccgcgggcgttgagccgctccgcgtcctgcgcggtgggtgtcggaccggtgtgggtgaacagcacgacgtcgtcgctccactgccgaaacagcagcgcctcctcgaccgccgagacctcctcggtcgccagcaccccgacgggcatcccgctgatctcccagccgtggcagtacgggcagtggatgacgtcgcgtccccaccgctcccgcaggcccgcgacctccggcagctcatccacgagtcccgtggcgacgaggacccgacgcgccgcagcccggcggccgtcggtgagccggacgtcgaaccctccggcggccgcggtgaccgcgtcgacctcgccgcggacgacctcgccaccgtacgcccggacctccttgcggccgcggtcgagcaactcggccggcgcgatgccgtccaaccccaacaggccatgcacacggtgggcggccgcgttgcgtggcgccccggcatcgacgaccacgaccgaccgtcgtgcccgggccaacgtcagggcaccgctgagcccggcagcgccgccgccgatcacgatgacgtcgtagtcactgcgcatgcgatccccttgtccgactgtctgccactcgccacccggacggtgaacgcgtgctgtccgccagggatccggtgcggagccgcacttgccgttcccggtccagggatggcggcataccctgcgcctttggcgggaaacgcccgaagtccagtccgggcggcaaccggttcccctcagctcgggaaaccggcggtcatgatcgtcgcgttccggcgcaaggcctgcgcggctcctgcctgccggtgcgccgagcgggcgtcatcgtaggaagcgggcgcggctcgctgccgaggcggggtgctcggcctgccggctgaccggtcagccggcggccgggtcggtggcgaacaggaaggacaggccgctgatgtccaggacgcggcggacgacgccgcgggcgttggccagccggaaccgggtcgcgtcgtgccggacggcctcgaatccggccagcagggcgccgatcgcctccgagtcgagcatcgtcacccggtccaggtcgaccaggatccgggtgccgtccccggcggcggcggtcagctcgtcgatgagggcgggacgggcggccaggtcgaattcgccgtcgagccgcacccgtacggtggtcacgccgtccgcggcgcggtaggggcggccgcggacgatggtgtagtagtcgtccgtcacgatagttgtctaccagcaaataattgcggcggcatctcggggtaccgcaactgcgcaaccgtcctgcacccggacgtgtcccggcggggcaccgcggccgtggtgacctgggtgccgtggccagtcgtctgatgcggttgcacgtggtgatcgcggtcgtcgccgtcggcgggttcctcgccgtgccggacggcagcaccctgcagctggtgtggcaggtgacggccggctggctggccgcggtgatgatggtcatcgggatccggcggcgccgcgtcaccccggcggccccgtggtggctgttcgccatcggggtggccggcaacgccagcggcatcctggtcgagtacatcctcacccacacccaggtcgacccgggcttcccgtcctgggcggacgccgcctacctgtcgctgtacccggccgcggccgccggtctgctgctgatgatccgccggcgcaatgtgcagcgcgactgggccaccgccgtcgacgccaccacgctgaccaccggcatcggcctgctcgcctggatcttcatgatcaagccggcggccgaggacccgacgatcggactgctggggcacatcgtcagcgtggcgtatccgctgggtgacatcgtgctgctggccatgaccgtacgactgctgctcagcggtagcggtcagaacgtgtccttccgcctggtgtcggccgccctgatctgcttcctggccggcgacggcacctgggcggtgatcaaccagctggcgtgggagccgggtccggtcccgcaccgcctgctggccgacgtgttcctcgtcggattcctgctgttcggcgccgccgcggtgcacaccgacgcccgctcgctgagccgccgcgtcgccccgcggccggcccggatcagccggtcgttgctggccacgctgaccgcgacctcgctgatcgcgcccgtgctgctgatcgttcagacgctgcgccaccaggtcagcgacgcgctgtcgatcgcggtcggctgcatcgcgctgttcctgctggtcgtcacccggatgacccagctgctgcggcagctcgacgcgcagaccgagaaggcccgcgaactcgccgtcaccgacgagctgaccgggctgcccaaccggcgtgcctggaacaccgaactgccccgcggcatcgaacggacccggcgggccggcaccccgctcaccgtcgccgtggtcgacgtcgaccacttcaagcgcttcaatgacgcgtacggtcatccggccggtgaccgcctgctcaaggaagccgccgccgcgtggcaggagcagctgcgcaccgtcgaccacctggcccgctacgggcggcgaggagttcgtggtgatgctgcccgacgccaccgccgggcaggcgcacgccatcctggaccggatgcgcgccgccactcccctgggtcagaccttctcggccggcctggccgagtgggacggcaccgagacctcggacgagctgaccgcccgcgcggacgccgcgctctacgaggcgaagcacgccggccgcaaccggatcgccgtcgccgcctgagcgcgcctcgcctcagccccgcaggtaggccaggacggccagcacccggcggtgtccctcggtggcgaccggcaggtcgagtttggtgaagatgctgccgatgtgcttgttcaccgcggcgtcggtgatggtcaacgtcgccccgatgaaggtgttcgcgtggccctgcgccatcagggccaggacctcctgctcgcgggggctgagccggtcgagcgggtcctgccggcgccggatgagctggcggaccacgtccgggtcgacgacggtcctgccggccgccacctgctccaccgcggtcatgaagtcggcgaccgcgccgatccggtccttgagcaggtatcccaccccggcgccgtcgccggagtcgagcagtttggcggcgtacgactgctccacgtattgactgagcaccagcaccggcaggcccggacactccccgcggagcgccaccgcggcgcgcaggccgtcgtcggcgtgccgcggcggcatccgcacgtcggtgatcagcaggtcgggccggtccgcccgcaccgcgtccaccagcgcaccggcgtcggcgaccgccgcgacggtctcgtgaccgaaccggcccaggatgccgatcaggccctcgcggagcagaggcgagtcttcggcgacgactatccgaaggggcacgggatctccacgtggatcagggtcggcccgccgggcgggctggagatccgcatccggccgtccaggacgcccagccggtcggcgagaccggtcatgccggtgccggcggccggatcgacgccgccggcgccgttgtcggtgatctgcagggtgagcacgtcggcatggtggcgcccggtgatccgcgcggtggtcgcgccgctgtgccgggcgatgttggtcatcgcctcggtgaccacgtagtaggcggccagctcgacggcgtgcggcagccgggcgggcagccgcacgtcgacgtccaccgggatggtgaaccggctggtgttctcctcgattgcggcgaccaggccgttgtcggtgagcacctgcgggttgaggccgcgcaccaggtcgcgcagctcggcgagagcggtggtcagctgctcctgcgcctcgccgatccggcggtgcagcgcggagtccggctcggtgtccagccgcagcagcccgagctgcatgctgagcgacacgagccgctgctgggcgccgtcgtgcaggtcgcgttcgatgcggacccgttcggcctcgaaggcgccgagcagccgggcccgggaccggcgcacctcggtcagctgctcccccagttcccggtcgcggggcgacaggatggtgcgggtgagcgcggcgcgcgcgccggcccacgacgtgacggtgtagggccacgccgacagcagcagcacaccggcgatcgcccacggccacaccgccgggtcctcgaccgcggcctcgacgcagatccacggcacggcgaaggcgaacgccagcaccaccaggtccagccagcacagcgcggtggccgacaggagggtgaaggccagctcgcgccacgtcgccggctcggccagccgggtgcgcagccaggcccgcgggcccggtgcggccggcgtctggtgcgggtcgccggtgcggtccgcgtcgaccagccgcaaccgccggcgttccaggcgggccaccgggaggccggacagggcggccgcgagcaggaacaccggtccgatcaggacgatcaggccggccacgccggccgcgatcagggcggccaggattgcgcaggtcagcgcgccggtcaggacacccgagaccaggtaggcgagggcgcgccacggccaggcggaacgcaggaaaccgagcgggctctgggccatcgcctgccacgctgtccggtttcgcaccccacgaccgtagggcatcgcggcggcgccgcgcagtagagcggactctaccttcgggactacagcagcggtcaatgtgccggccccggccggcgggatctgatgaccgccatgacgacctccctgaccagcgtccgcaaggtgtacggacacggcgaccgggccgtgaccgccctcgacgacgtctccctgcacttcccccggggcagcttcaccgccgtgatgggtccctccggctccggcaagtccaccctgctgcactgcgcggccgggctcgaccggcccacctccgggcagatcctgatcgcgggccgggacatcggcgcgctcgacgagaacgaccgcacccggttgcgccgcgaccggatcggcttcgtcttccaggcgttcaacctggtcacctcgctgaccgccgcgcagaacgtcgagttgccgctgcggttcgccggccggcggcccggccccgacgcggtgcacgcggcgctggcccgggtcggctagctagctagggcagcagcagcgggtcgccctggcccgcgcgctgatcaccggcccggaggtgctgttcgccgacgaaccgaccggcgccctggacacggtcacctccggcgaggtgctggcgctgctgcggcaactggtcgacgacgagcggcagaccacgatcatggtgacccacgatccggtggccgccgcgtacgccgatgtcgtggtgttcctcaaagacggccggatcgcggaccgcatgacgccgcgccgggacgctcccgagctgatcgcggcccgcatgacccggctggagggctgaccgtgctcgccctcgccaacctccgcgaacaccggcgctcgttcgtcgccgccctcctcgccgtggccctcggggtcggtctgatcggcgtcacgctgctcgtctacgactcggcgcgcccgcgggtgccgtcccgcttcgcggcggccccggtgctggtcgtcccgcatcgggccgccgacgagagcggtcacctccgggatctgatcccgtggagcgaggcggacgccgccgcgctcgcccaccggctccgcgacggcgcggtgatcgaccggtcgttctacgcccaggcgttcctcgacgggcggccggtggccggcgacgcggcccgcgacgccgggcacggctgggcgagcacccggctggcgccgtaccggctggtggccggcgcggcgccgcaaacccccggcgaggtggcggtggacgcatcgctgggcgtccggcccggtgaccgcctccaggtcgacctggcctccgggccgcggcggctgaccgtgtccggcaccgtcgacgggccgggcttctacttcaccgacgaggctgccgcgcggctcgcccccggcgtccgggcgatcgccctgctgcggcacgacccgggcacggcccgcagcgcggtcggtgccgccggcacggtcctcaccggggacgcccgggccgcgctggagccgcagttcgtggcgcacaagcgcttcctcggcacccagctgatcacggcgatggccgccctgggtctgttcgtcacggtgttcgtggtcgccgccaccctggcgctcgccaccacccagcggcgccgggagatcgggctgctgcgcgcggtcggcgcccggccgggacagatccgccggatgatcctcggcgaggcggccgggatcggcctggccggctcgatggccggcgcggcgctcgcggtggccgccgcgccgctgatgaaggcgatcctgaccggcctggacgtgaccgcccccggcttcaccatccgggtgtccacctggccgctggccgccgccaccctgatcggcgtcggggtggccgtggccgggtcctgggcggcgagccggcaggccgcgagcgtgacaccgttggcggcgttgctggacgccccggccgcaaagcgcgcgatgacgccggcccgcggcctggccggtgccggcgcgctgagcctgggtgcgctgctcgcggtgctgaccgcggtctccggcgcggacgaccggatcaacacggcgatcggcgcggccatgtgcttgatcgtggcggcggcgctgctggccccggtcctgatcggcccggtcgtccgggtcgtcaccgcgccgctggtccgcagacgggcgtcggccggcccgctgctgatccgtgccgagctgctcgacgccgccggccgggcggcctcgaccgcggcgccgatcatcgcggcggtcggcttcgcggtgctgatcagcggcatggtgcagacgatgcggacggcgtacccggccggcgagaccaggaagctggccggtcaggtgctgatcgccccggacggcacaccgggcctcgacgaccaggtggtggcggagcacccggtcggcaaggcggcgctgcccacccgcgtcttcctggaccgcccgggccgggggccgaccgtgatcgacgctctgggctcccgggacccgcgctgggaccggccgggcgaggcggtgctgggggtgagcaccgcccggatgttcggtgtcgccgccggacgcaacgtcaccgtccgcttcgtcgacggcctgagcgagaccgtccggatctcccaggtcctcccggacgatccggcccgcggcgccttcgtgctgtcccgggcgctggtccgccggcacgacccggccgcactcaccgacaccgtcttcatcccgcaggcggacgccccgcggacggtggccgccggcgccgcactgcacgacgcgcagagctacgccctcgccgactacgacaccgacgcccgcctcaccgccggcctcgcgacgatgctgatcgtggtggcggtcggctacagcggcctggcggtggccaacagcatggcgatggccgcgtacggccgccgcgacgacttcgcggtgatgcggtcggccggcggcacggtccggcagctgatcggcttcgtggccggcgagaccgcgctggtcgccgccatcggcatcactctgggcgtgctggtcacgctgccgccgctggccggcatggcctccggcctgtcccaggtcaccggcacggacgtcacgatccacctcgacgccggcacggtcaccgcggcgatcctcggctcgctcgtgacggccgtcggcgccgccgtcgtggtcacctggcgggttctgcggccggatccgggtggcaccgccggtccgcggtgaacgatcatcacctggtggcgaatcgacaggcggcggtggcggcgatgcgggggctggcgctcggtgacgcgttcggcgagacctggctgatggagccggccgcaaccctggcggacgcgctgctcgcgcggcacgtcaaggacgggccgtggctgtggaccgatgacaccgccatggccctgtcactgctgcgggtcctggaccggtacggccgcgtcgaccaggacgcgctggcggtggcgttcgccgagtcgtacgccgcggacccgtaccgcgcctacggccccgccatgcacgacgtgctgctggccatcggccgcggggtgccgtgggccgaggcgacccggcgcaagttcgacggcatgggctcgtggggcaacggcgcggcgatgcgggtggcgccgctcggtgcgtggttcgccgacgacctcgacacggtggtggccgaggcgacccgctcggcggtggtgacccacgcccatcccgaggcggttgcgggagcggtggccgtcgcggttgcggcggcatgcagcgtacggggggtgcctcccgccgagctcatcgcggcggtcaccgaccgggtgccggacagcgaggtcgccgcccgcctgcgccgcgccgcccggatcgcgccgagcgccgacccccgccacgtcgccgggatgctcggctgcggtcgggagatctcggcggtcgacacggtcccgttcgccgtctggtgcgccgccacccatctcgacgatctcaccgaggccctgtgggccaccgccctccccggcggcgacatcgacaccacgtgcgccatcgtgggcggcatcctcggcggccgcaccggcctgaccggcgttcccccggcctggctggccgcgtgcgaggcattaccgccgttcgtcgacgagatcggcgacgcacaccgcgcttcgatcggccgggtacacacaccctctcggatgtccgggctgcccgaactgaccggcgtccggaaggtgtggttcagcggttggtacgacggaccggtcaccggcatcgcggaacacgacggccacgagtactggttcgtcatggtcgtcaacgacggcggcggggcctgggacttcgaaccccgcgtctacctgctgcaccgcctgcccgaggagcagttggccgaagcctggcaggcacatcggagcttcacggcggccggcctgcccggatgcctgcactcgccgccgtgcccggtcaatcccgccgaagcgccgacccgggaggcgctctgggagcgctggccgccggagcaggaagaccactacgcggacgcgcccgccatcgggtggttccgggatgcggcaggctgatggtgtagtcgtgggtggagcggacgagggagtgggcccgtggcgcgcgtgatcatgcaggcggtcgtgtcggtggacgggttcatcgcgtatccggacgactcggtggggccgctgttcgactggtacggcaacggggacgtgaccgtgcacgcgaacgagcagtgggcgttccgggtgagccgggcgtccgccgaccatgtgcggccgttctggggtgacgtgaagtgcacggtgatcggccgccacctgttcgacaccaccgacggctgggcgggagtgccggccgccggggaccaggtgatcgtggtgacccatcggccgctgccggcggagtggctcgcccggttcccggacgctccctttcgtaccgccggatcggtcgaggccggaatcggcctcgcgaaggaggtggcgggtgacggcctggtctgtgtgaccgccggggatgtgggcgggcaggcgttcacggcgggcctggtggacgaggtggcgatggatgtggtgccggtggtcttcggcgcggggaagcgattcttcggtgcgcacaccggcaccgtcctgctcggggatccggacgccgtggtgcggggcgaccgggtcctgcacctgcactacacggtgcggcgctgatccgtcgccagagtggcgggctcggggtcgacgcggcgctcggtgaacagggcggcgagcacggcgccggcgacgaagccctcgacgatcatcaggccgtgcgcgttgtcctgcacgaaccaggtcgccagcccgacgagcggcgcggcgaccgcgagcaggccgtccttgacccgccgggtgcgcagcgcccggatcgcgagcgcgccggccagggtggccgcgaccaggtaggtcacgccggagctgcccgcccagttgcgcggctcgttgctgacctgcgcgtcgccgacgaacacgtccagccagtgcgggatcagggcggcggccaggaacagtccggccgcggcgagccgcccccagtaccactcggcgtaggcggcgataccggcgatcgtcaggacgttccacagatcgccggtgaagccgccgttctgcatgagcaccgaggtcagcggccgccaccagccgctgcgggacgggtcgctgtccagcgcggccatggcgccgggccaggtggcctgcaggatcaggccgccgatgatcagcgcggtgagggcgacggcgaccaccgggaagcgccgccgcggggcgagtcgctgggcggccttgaacgccaggatcagcacggccgccgtgaccatgttgtagagcaccacgtccatcgtcatccccctggttttgaacggtgtttgaatcgaccgtagcagtttcaaacaccgtttgaaagtgggtatgctcgacccgtgaagctgaccagggagcgcatcgtcgaggccggcatgctcacgttcgccgagcacggatacgccgggctgtcgatgcggcaggtcgcggagcggctcgacgtgcacgccgggtcgctctactaccacgtgcgcaacaaggaggcgctgctcgtcctgctcgccgaccggctcgccagccgggccttcgaggccggggagaaggcgttggccgagctgccggagtcggcgggctgggccgaccgcgtcgaggcacaggcgggcgcgttgcgccagacgctgcgtgcgcacgccggtgggccgttgctgctggcaggcagcccggccatgctcagcgcccaggccctcgcgctgatggagcggctgctggccaccctgcgcgacggcggggtgcccgaggccgaccgcacggtgctggccgacgtggtgctgagctacgtcaccggcttcgtgctgcaggagcaggcggagccggagaccgcgccgcccggggacgtcgaccatgctgcgctgacggcccggttcccgctgctgttcgccgcgcccccgggaagctccgacgagatgttccaccgcggcatccgccagatctgcgcacgagccggcagctgaaagtcatacccgaaccgcttcacgatcttcgacgaaggtcatgaccggacgccggcactgtcgaccgatgcccggccggcgactcactgggaagcgcgcgaagcacgacgacgatcgcgatcaggaacgacaccgcgtacgcggtcagagcgagcctcggccgggcgggtagatcgaggaacacccccagccagttgccgaggatcgaggccgccgcgacgaagctgaacgaccaactcatgatccgtacgaacctcttgcctttgaaggcctactgacgcagcgtcaccgtcaacaccgcacgcgcgcgggatacgacgccgagcgccaggacgaacgccaagccgatcacccagaggcggtgtctctcgaccacacccgcgaaaacggccatggcagacgagaccacagcggcgaaggagtaggtgaccagcaacgcggtcctcggcgcgagagtgcggcggaggaccggagcgacatacggtccgatggtcgcgcccacaccgaaggcaagcaggaccgcagcgagcgcggtgcccgccggccacggcgtgaacgaggccacccacaggtagacgaagacacccgccatggtggccccgaccttgagcacgaactccatcgccggtgacgtcggaccggtccgcagcagatcggagagaaattctcgcagcttcattcgtccgccgaccgcgctgcactcacttacgtcctggtcgtagatcgctccgaccatcaacgtacgggagctgacgagccggaaggaaaaaccgatgaaggagaagagcgcattcgccgccaccagccatacgatcgatcgaccggtcagccaactgcccagtggcattccgaccgccagccctacgaaacccagcaccgagtagatgttcgtgttgaaggcaagcgcctctttctcatccagttgcgctatctgctgaccgtacaactcctctacgacatccataatggccggaaagacggccacgaccagcagatacccacccaacaaggtcgatcttccgccgggagacaccacgagcaggatgagggcgatgacggataccacggcttcagccagatcagatgcgaccagggttctggccgggctgtgaggcgcggtcaatctggcgatcagcggggcagcgaaactgatgccggcgctcccggtcgcgaggacggccagccatgccaacggcaggacgctctccgccaccgctccgctcgagccaccatcgacgacccgtgacccgatgatcgacgtggccagcccgagcgtcatccatcggcgcgccctggccaccgtggctacggatactgaaatctcatactcctgcgaggggcacaagttcggcctctctgccgggccctgaagggctcggcaatccgcaggatacacaaaaacgtggtccagacatcatctaggctgaacgatggaatgtcaccctagtttcgtcgccccccgattgtacgactatagagtaggtcccgaatatcaaggtcaatgactgcgccattgacggtgacccgcccgactcccaccgatccagcttccgcccgaggtattgacgatagctccacgccgaggaacccatatcgaaaatctcccatttgcctgattctcgaacgaatttttcattctcaacggaaagtggctcctcgaagtattcagtccaagggccttgagtgatggtgagcgcctccccgctggagcccgcctgtatcaggtagcttccggacttctcgaaagacacctccaagggcccattcggggcatagaggtccgcgccgtacacataataggatcgccggatgccggtgaggcgctcaccgataggcagctcacttggtgaagatgacaggggcacgatcccaccgcccattccctgtttcggcgtggagcgtagtgacggatgcaccgtctgccgggcgtccccacgctacgccgagcggaaaacttgacacaactgtgcagaactcggcggccaaggatctctagatgctcgggcgggtctggcagcgcccgtaccagtcgcagcaaactgctgcgactggtgatcatccccagcaccgcggcgagccgtgcgctgcccggcccgcgagcgccagaccgatcgccgcgagcgttcgccgcaggccatggcggcctcgtcagcacgcccaatgcagagggcccgttcgagtgggaaactcgaacgggccctctggttcatcatttcttcctgcggcgcatcaggcgggtgccggcgttatctccagccgttctacgagttgctcctaccagcatcaaccagctcagccagtagcaggttgaatgactccctagatcggcccacgtattcacggaacacgtcatcagacggtatcagtctgtcggcccatcccagggccgagattagggtgtttaaatcgtgccgggtcagcttgaggtggaagaactcctcatcgcgcgcgatttgcatgctgtctcccctcttcgcaccgagtatctgccgggtgagctcgcgcagtgtgacctttggtttccgccggtcgacgtgccgttggggttcgggcaggtcggcaggccaccagtgctggtgacggtcatcggctattcgcgctggctgacagcgatgatgatcccgacccggcaggcccccgacctgcttgccgggcattggtggctgctgaccggcctgggtgcggtcccgaaagcgctggtctgggacaacgaggcggcggtcggctcgtggcgggccggcaggccgcagctgaccgcgaccgcacgtcccgagccggtctcggccggtatcggcgctcagcgcttcaggtaggccaggaccgccagtacccgccggttgacgtcgtcggagggtacgagatcgaggcgggcgaagatgcttgcggtgtgcttcgcgacggcgctctcggtgatgtgcagaccggcggcgatcgcggcgttggagcggccctcggccatcagttcgaggacgtcgcgctcgcgcggagtgaggctgccgatccggccgcgtgcctcgccgcgagccaggagcttgaccaccacgtgctggtcgagcacggtgccgccggcggcgacccggcggaccgcgtcgaggaactgctcggcgttggtgacgcggtccttgagcaggtagccgatgccaccggcgccgtcggccagcagttcgtgggcgtacagctgctcgacgtactgggacagcacgagcaccggcagacccggcagctcgcggcgggcctcgagagcgacccgcaggccttcgtcggtgaaggacggcggcaggcgtacgtcaacgatggcgacgtcgggtttctcggtcagcagcgcgtgccgcagcgaaggggcgttgtcgaccgcggcgaccacctcgaaaccgtgctccctgagcgtacggctcagtccgtcacggaggaggaagaggtcttcggcgaggacgacgcgcacggaatctccatggtcacctgggtggggccgcccggcgggctggcgatggcgagggtgccgtcgaacctatcgagccggcgccgcacgccgcgcagcccggtgccgttcgccggatcggcgccgcccgcgccgtcgtcggtcaccgtgaggtgcagcgcgtcgccgtcgtgggtgatgctgatccggacggtacgggctcgggcgtgtttgccggcgttggcgagtagttcggcgacggcgaagtaggcggccgactcgaccggtgccggcagccgacccgggagctcggcggcgacctcgacgtcgaggaagctgtcgagcgcgagggcacggacggcgtcaccgagtccccggtcggcgaggaccggcgggttgatgccgcggaccagatcgcgcagttcggtcagcgcccggtcggaggtcgtgcgagcctcgaccagcagccggcgcgcttgcggcaggtcggtgtcgagcagccgggcgacctgatcgagggtcatgcccatggctacgatccgggcctgagcaccgtcgtgcagatcacgttcgatgcggtgcagctcggtggcctgcgcgtccagggcctcggcgcgcgtgtcggccagctgcgcgatccgccgcgcgagggcggcgttgcgcggttcggcgagcatccgtcgggtccagcgggcgtgccggtccaggacgaccgtcgcgctggtcagggcgatcgcgacgaagccggcgccgagcatcagtgcggccagcatggtcgcaacactgtcgaccgggatgaacgcgtaccagttgccggggccgagcgaacgccagaggaacggctgcacgaggacgccgaagatcccgtaccagaagaaggcgatcgggacggcgagcagcaggccgccggtcagcgggtcgaccatcgcccaggtcaggtcgcgccagaacgcctcggtgccgaggatggcgaccgcgcgggagggcagcgggccgggccggtcggtcaccccggcccagccgcgggcgacgtcggacacccggcgtagcagcaccgcggccggcgtgaccgccaggaatccgacgccgaccggcagcgccagcaccgcgagcatcgtcagggacccggtgagccaccccacgattgtgaaccagctcatgagctggcatcgccagagccccctgatcatcggcgagatgccgtccccacgagcgccgccaccgcggcggacgctccgaaaagggcgatgggcagtacggcgccggactcctcgttcatgaacagcagcatgcctagattgatcaacgtgtggaagcccgcggccagcagtagccggtacgaccgggcccgttccagcgccaggcccatcaccacggacagcgcgatcgtggcgagcaggaagaggcctccgtaccaggggccctcggcgaacacggggacgtgccagagaccccacagcaggccgaccagcacggacgcggtgagcgggccgaaccgcgtacgcaacagcggttgcagcaggcagcgccagccgatctcctcgccgcacgcaccgatcagctgggcgaccgcgatgagcaggaacggatgctcgggccgggtgaaaccgacgcctccggtgatcacgccatgggccccgaccgcgccggcgacgatcagtacagcggtgctcaacagcaccggacctgtccgcgcttcgccggagccggcgccgtggagcagtgctctcgtgcgggccggccacaccccggccagcaccgcgacggcaacggccggcccgaactgggtcagctggatgacctcttcgggaatgccggtgaaaggttgcacggcgccgaagaccccggccgctaccgtggcgacggcaaagaagacggtggccatcggccatacccgcgaacgacgaactacctcggtccgaaccacgatgcgcctcacttgacagggaaacaggaacacccacgacgatccgtttccgtgccgcgtgtgccattgcacctgggaccccgaccggggtgtatccaggtacaggtagctggacgcggtgggcgatcacgggctcggccgacctccttcagcacgcgaagcggactccgacatgcacggcggcggcaggcgccggaaaaatcttgaagaagatcccggcccggctgtcgattcggcggcagagtgttcgtcgtcgctgatgacggagccggacaggccggcccgcgaaccggtgcagggagcagctccatggccaagtacgccatcctcatctacgaagacccggccttctacgcgaacatgtcgcccgaggcatggggcacggtggtcgacgcgcacagcacgttcgtcaaacaggtcgccgagctcggtgggtccatggcgggcggcgaggcgctcgcgcccacgacgacggccaccacgatcaagggtgccggcacggtgacggacggcccgttcgtcgagaccaaggaggccttcggcggcttctacgtcgtcgaggcgcgcgacctcgaccacgccgtcgagatcgccaggctgtgcccggctcccggcggcggtgtcgaggtccgcccggtcgtggacccgacgacgagcccgttctgatcgctgccgacgacgagccgaccgcgtccgccctgcaggcggacgcggtcgctgccgcgctggcgcaggcccaccgatccgagtgggccttcgtgctgtccgccacggtgcgcgtcacgggcgacctggacgtggcggaggaatgcgcgcaggaggcgtacgtcagcgcgctgcgcgcctggacccgggacggcgtcccggagcggcccggcgcgtggctgaccacggcagcgcggaaccaggcgctggaccggttgcgtcgcgaggtcaccctccggcgcaagctcccgctgctcgtggagccggcgaccgtcgatccgcacgacccggccgacccgaactcgcccgacgccgcggtaccggacgaccggctccggctggtgttcacctgctgccaccccaccctcgcccccgaggcccgcgtcgccctcaccctgcgcctggtctgcggcgttcccacgcccgacgtcgcccgggccttcctggtgtccgagccgacgatggcggcccggatcacccgggccaagaagaagatctccgaagcgcggatcccctaccgcgttccgggccgggcggagctgcccgagcgcctggacagcgtgctcaccgccgtccacctgctcttcagcaccggccacacggccggcgagggggacgcgctcgtccgtgcggagctctgcgaccgggccctgcacctcgcgcgcaccctcgccgcgctgctgcccgagcaggccgagacccgcggcctgctgggcctgctgctcctgaccgacgcgcgccgggccacccggaccgacgagcagggccggctgctcctgctcgccgaccaggaccggacgcgctgggatcagcgcgcgattctgcaggggctcacggtgacggccggggcactggcgtccggaccaccgggacggttcaccctgcaggcggcgatcgccggcgtgcacgcggtggcgccgtccctggagcagaccgactggccgcgcgtcgtgcacctctacgacctgctgctggcggtgtggaacaccccggtggtcgcgctcaaccgggccgccgctgtggcgttcgcggacggcccggccgccgccctgccgctgctcgacgagctctcgaccgagccccggctcgccgactacccctaccttcccgccacccgcgccgacctgctgcgccgcctcggcgacgccgccggcgcggctcaggcgtaccggcgcgcgatggagctcacggcgaacgccgcggagcgcgccttcctggagcagcgcctggccgaggtcagccgggccgccggcgccgagcccgcgcccggctgaggacggcgggcccgcgatgccggatgttccccggtttcagccgacggcgaccgcggcagggatcggctctgagcccgctgcggccgcggcagccgacgcacgggaggtgatccaagcgatcaactggtcggccggtaccgggcgcgagtacaggtagccctgggcctggtcgcagccgaaacgttggagttgctcggcgccggcgagatcttcgacgccttcggcgaccatgcgcaggccgaggctgtgggcgaggatgacggtggacgagaccagtgctgcggcgcggtcgtcgctggtggcgggcatgatgaaggagcgatccagcttcagatcgtcgaccggcaggtcccgcaggtaggccagggagctgaacccggtgccgaagtcgtcgatggcgatgcgcacaccggcagcccgcagctgggtgaggaccgcggcggcgcgttcccggtcgcccatgatcgcgtcttcggtgatttccaactgcagcgcggcgggagccaggtcgtactgacgcagcaggtcggtcatgcgggcggccagctgcgcgtccatcagcgccgacggcggaaggttgaccgccacgctcagcggatggccggcggcatgccagtgcgcggcttgacgcagggcgaggtgcaggacggtcgtcgtgagttcgtgcatcaggccggcgtcctcggccaggcccaggaacgcatccgggtatagcagcccctggtgcgggtgctgccagcgcaccagcgcttcgacgctgtgcacctgaccgtcgtgcagatcgatcttgggctggtagtgcagcaccagctgaccggtgcgcaggccctcgcgtagttcctgctgcagccgcagccggtcggcgctggcctcgtcattgttcggctgccacagctggttgccgtaccggccgctcttggcccggtacatggcgatgtcggcgcggcgcagcagcatggcgacgtccctgccatggtgcggggccagggcgaggccgatgctggcgtgcgcgtgcaccgtgatgccgtccagttcgaagccggcgctcaacgcctcgtgcacccggtcggcgatgctcagggccgcgtcggcgtcaccggcgtcggcgaggaccacgaactcgtcaccgcccaggcgcgccagcaggtcccccgcccgtatctgggcggcaagccgccgcgcgacctgctgcaacagctggtcaccgacgtggtgcccgaggctgtcgttgacttccttgaaccggttgaggtcgatcagcagcagcgtgaaggggctgccctgggccaggcggcggccggcgtggtcgtagaaggcacgccggttcgccaagccggtcaggtcgtcgctgcgagcctcgcgcgtgagctgcgccatacgtcgcagctgccggtaagccacgtgcgtacggcctgccgaggtcagcacggtcgcggtcgccagcagcaggatgacgcgcgatagggaggcggtgctgccggccaccagcacggccaacgccacaccgctggacagcccgggcaccagcagactgggcgaatacggctgctccccggaatcgatgccggcgccggagcgttcccggccgcagcgcacggtccaggtggccagggtggccagccccagcgcccacaggccgtccatcggagtacccaccgtgtagccgccggcggctacccgcagcgtgtagctgatgtccgcggccgcgaacagcgccagcccggcgatcagcggtagccaccggcgcgggaaccgggccccgtgcaggcacatcagacccagcagcaccgccaccagcgtcatgtccgcggcgggataggcggcggccacgatcatctgcaacgggctgccgctgatgccggagaacaccggggccagcaggacggcgaggcctgtcgccccgccgagggcggcgacggcggcgtcccaccacacctggccgctacgccgcgacaacgcacgacgcgccacggtgaccagcgcggccaggaccgccggatagaacagcagaaatccggcatcactccaagcgggggtcaccaccgtgacgtgccgggcagcggccatggccagcagggcgttaccgatcgcgtagctggtgcagccgaccgccatgaacaccagttccagccgccggccacctgcggtcaggacagccgcccagcacaccagcgccggcgcggcgatcgcggcgatgttgagccacacgtccaccgccaccacgaaacccggaggctgcagaaccagacccaccgtgtacgccgcggcgatcacccacatcaccgcaccgaccaggcccgtcagcgagggagacaaccgtcgtgtcgacaacctgcattctcccgcctgctcgccccacgtccggtcaccgatgtcttcccatgtatcggtcaccggaccggggatgtgaccataacggggaggctcgccccttcgacgaggttcttgctccctcgtcgcgggcaggcggtgttcccggttgcccgtcacgatctgtcctcctgccaggtactgcggccgggcgtgcggcgggcgtagcagcgctcaggccgggaaatctgattgctgatcacagatcagagcgcgccttactgcatgcattcttgtaccggtcgtcgcgacctcctcgaacagctccacgcacccgtcccggtacaacctcgctgcgggcgacggcgcggtcagcggccagctccgcaccgacctcgccgagccctgatggcccttctcgatggttctgcggtcaggaaggaactcgagccctggaaggctgttcatcggtaagcagcattgccgaccaccactgacatatcgatggatgtcaggtgtgagaagcatgggccataccgcgcgccgcaccggctgaggccgccatgggcgctggccggaggccaggtcagcatgccggcgtaggtgccggcgtctgcacacggtgccggacgggcgctcggacgcgaaggtgtgacgtagcgctgaacagtcggacttaatcgcggcgggttgcttccgatacgtccttggtgagatcgggacgccgcgccagtgggacggtcagcccggtgccggcacccgcagccgatgaggttttccgcggtgggaccgggctgcgacggcggctgtggtggctcaccattgccctcgggatcgcagcgatcggcggctacttcctgcttcccggcggcggcttcgcgcaagccgtggcgtacaacgccatgggtctgctgtccggactggcgatgcttgcgggggtgtggctgcaccggccgtcgcggcgggcgctgtggatcttcttcgcggccggacagttgatgaacgtcgccggcgacgtcatctggaacatctacgagtacgggctgcaccaggaaccgttcccgtccgtcgctgacatcttctacctgggcagctatcccctgttgggggcagggctggtgcgactggtgcgccagcaccacggccgccggccgcggcaccttctcgacgcggccatcgtggcgaccgggaccgggctggtgttctgggtgttcgtgctgcaccccgcggccgccgccgcggcgaacaccccgctggaacgcatgatcaacactgcctatccggctgttgacgtcatgctgctggccatcctggccggtctgttcacgctgcccggtgcccgcaccgccagcacgtggttactcgccggagcggccctggcgctgctggtcgccgacgtcggctactcggtgctgaccgctcatctcagcttcgacgacggcaacccgctcgacgcggcatggctgctgtcctacgtgctgtggggagccgcggcgctgcacccttccatgtccgcacggccggccgccatagcgcacggcgtggggaccgggctcggccgggggcgccaggcgttgctcgccgtgtgctccctgctggcacccggcctgctgttcgtgcccggcgtcgccgcccgccccgcggactggatggtggcggccgccggcacggtggcattgttcctgctcgtctcggcacgcatgtcgggattcgtgaaccgggtgcagaaacaagccggccagttggagaagctggccctacacgatgagctcaccggcctggccaaccgccgccggttccaggcacaactgagcgcggccctgggcaacggtccgtgctgcatcgccctgctcgacctgaccggcttcaagaagatcaacgaccagttcggtcaccgggtgggcgacctgctgctcgccgaggtggccggccggctcaccgcggccgccgaccatccggcctcggtggcacggatgggcggcgacgagttcaccctgctgctgccggccgcctcgcgggagagcgccaccgaggtcgccgagcacgtccgccgcctgctcgcgcagccgatccgggtggccggacacgagctgctgatcagcgcgaacatcgggctcacggaaacggacagcctcggcgacccggtggaggcgctgcgccgcgcggacgtggccatgtacgcggccaaggaactcggtgagccgtaccgctggtacgacctcggactcgaccggcgcgcgggcgaggacgcacgtgtcggggccgaactgcgtaccgcgctggatgccggccagctgcggctggtctaccagccgatcgtcgaactgcccactggccggcagatcgccgtcgaggcactcgttcgctggcaccaccccgaccgcggagtgatcagcccggcggagttcatccccgtcgccgaacgcaacgggaccatcgtggaaatgggtgcctggatcctgcgcacggcgtgcctgcggatggcccgctggcatgccgagcacggtccggccgcgccgcggcatgtgagtgtcaacgtgtccgctcggcagctggcccgccccggcctggccgaagtcgtggcgtccgcgctggccgacagcgggctgcccgcctcctgcctgacggtcgaggtcaccgagaccgccgtcttcgagaccgaccgtgccatccagacgctgcaccaactggacgcgatgggggtacggatcgccctggacgacttcgggaccgggcattcgtcgctcgccttgctgcgcaccgtgccggcgcacgcactcaaggtcgacaagtcgttcgtcgacgaggtgaccgtcggcggccgaacctcggtgattgcggcggccctgatccaggtggccgacgcgctcggcatgaccgctgtggccgaaggcgtcgaaaccgccgagcaggccgcagaactgcaccggctcggctaccggctggcacagggctatcacttcggtcgtcccgccgagcagccgctgccagccgagctgccactcatcgccgaagccgcctagtgaggttcctcggtctgcggctggaatgaccgagcccgcgcccgctccgccgctgcatacgcgccatcgcggctcggcacgtcatccgaggcccaaccgggcaccagcatcagatcgccggtatcaccgccggccagcttccactcgtgcgcgaagttgtgccgccaccgatgcgcgtgaacagtcgccacaccggcgagcgcaccgcggcgccgcagcatgatcttcacaccgttggcggcaatcggtgtttcgcctcgctcgggcacccgcagcgccggcgggtccgcggcacggcgccgggccagtagttcccggcgctgccgggcgcagtaagagtcacccgtcaagcgcactggtcgcagtctttacagagagatattgaagttttacgatcaggcaacgcaagtgaacgaacattttcccgcacattcgcacgcagggggtcacccgtggatcgtcgaacgctcctgacttccgtcgcggccgtagcggccgtgacaccgttcgtgggtggcggtgcggcgcgtgcggccgcgcccggctatgtgaccaaccgggccccgttgcagcccgaggcgttcatcaagctcaaacccggctcgaccaaggcggccgggtggctggcgacccagctgaattaccagctgaacggcctcaacggacggatgaccgaggtctcgcatttccttcagtacgacaacaccggatgggtccacccggaccttgccggctgggaggagctgccctactggctcaagggatactccagcctcggctacgtcacgggtgacgcgaacacgcagagtgtgaccgcgaagtgggtgaacggcatcctggcgacgcaggccggtgacggctatttcggcccgacagcgcagcgcacgagcctcaacggtggcccggacttctggccgcacatgccgatgctgcacgcgctgcgcacctttgccgaattcaccggtgatttccggatcgtcccagcgttcacccgattcttccacttcatgaacgctcagccggtgagtgccttcaaccagagctggggtgcccagcgctgggcggacacgctcgaggtcgtctactggacctacaaccagacaggcgacagcttcctgctcgacctggcccgcaagatccacggcaactcggcgaactacatcgacaacctgccgacgctgcacaacgtgaacctggcgcaaggcttccgcgagccggccgtctactcggtactcagtggggacccctcgcaccgggcggccagctacaacgactacaacatgatcatgaattcgtacgggcagttcgcgggcggcgggttcgccggtgacgagaacgctcgccccggcttcggcgacccgcggcaggggttcgagacgtgcggaatcgtggagttcatggccagccacgagatcctgacccggatcaccggcgacccgatctggggtgaccgcacggagaacctggctttcaactcactgccggcagcgctcgacccgcagcagacgggcatccactacgtcaccagcgcaaacagcatcgccctgctggaccggccgggtcacgccggccagttccagaacgggttcgcgatgcaggcgtacatgctgggcatcgacaactaccgctgctgcccgcacaactacggcatgggctggccgtactacgtcgaggagatgtgggtggccacccccgacggcgggctggccgcgacactgcacgggcccgcgacggtgacggcgaaggtcggcgacggcaccaccgtttcgatcaaggcggacacggtctacccattcggggaaacgatcacttacacggtgacgacgccgaaggcgctggcgttcccggtctacctgcgcgtgcccggatggtgcacaagcccgagtctcacggtgaacggcgccgcgcagactgtggcgggcgggcccgcgtacgcaaaaattgccagaacctgggcaaacggtgaccggatcgtcctcaaactaccgatgcaggcgaaaacccgcacctggacggcgaatcatcggtcggtgtcggtggacttcggcgcgctgaccttttcgctggcgatcaccgagagctggacccgggtgggcggctcggcggcgtggcccacgagcgaggtgcggcccggttcggcgtggaactacgggctcgacggcgccacccagttctccgtgacgaccggtctagggaacgtcaacgacccgttcaccgcggcgaacgcgccaatcaggatcacgaccccggcccggaggatcaccggctggaaggcggacgcggacaccatcgtcacgacgctgcaggacagcccaacgccctcgaccgaggcgatcgagcagatcaccctcattccgatgggcgcggcccgcctgcgcatcacctcgtttccgacgatcggggccggcacgccgtggcagagcgccggcgtcgcgttccgcatccagaaccagaacagcggcaaggtgctcggcgtcgactcgatgtcgaccacgaacagcgcacgggtcgtgcagttcggtgacaacggcacagccgatcacctgtggcgtttcctcgacaacggcgacggctgggtgaaaatccagaacgtcaactcgggcaagctgctcgccgtcgacgtgatgtccaccgcggattccgctcaagtcgtgcagttcgacgacaacggcacggccgaccacctgtggcaggtgctcgacaacgcgaccggctacgtccggatcaagaacaagaactcaggcaaggtgctcggcgtatcgggcatgtcgacggccgactcggcgaacgtggtgcagttctcggacaatggcaccaccgaccacaactggcgcctgatcccggacggcaccgtgaagctccaggtgacccacaccagcgacgtgctcgccatcaacaacatgtccaccgcgaacggcgcccagctgcagcagtacccggcggtcggctccgccgaccacatctggaggttcgaggacgctggaggcggtcacttcaagatcctcagcaacatggacggcaaatgcgtcgacatctccggccagtccacggctgacggcgccaaggccgtgcagtgggattacctcggcggcaccaaccagcagtggcggctcgtctggaccgcgcccaacgtcttcgcgctggtggcccgtcacagcggtaaggtcctcgaggtacagggccagtcgaccgccaacagcgccgacgtcggccaatggcccgaccttggcctcgccaaccagcgctggcgcatcatccccgcctgattcctctcgaggggtcggtcgttgatcaacaggccagtcctgctgagagcgttgatccgccaatcccactggcagattcgttctgtgattcggctatgtcacctactgcgtcggcgatcgcgtctgcgcaggtcagcgacaaaccttggcgatcgagacgttcggcaaccacctggcgtccggtcaagtgggagtcgaaaccaggtccagtagcgtggtggcggggatcgggagcgtcagttcgaagatcgagccgtggccgggcgcgggccggtagttgacgtcgccgccgttggcccgggcgagttcgcggacgatgtagagccccaggccggtgccggaaaccgtgccggcggtccggtgagcgcgggtgaaacgctcgaagaggtgtgtacggaattccggcgggacgccggggccgtcgtcatgcactgcgacggtgacgctttggccgctgtcggagggcgccgcgacgatcgcggtggcaccaccgccgtacttggcggcgttgctgatcaggttggtcaggatgtggtcgaagtgaccgggttgcatggcggcgaccagatccggtggacaggtgacgggtaggccggcggtggcggtggcgctcaatgccgcgtcgatgtgctcggccacccggatcggttggggcagcgcggtcagccgacccgcgtcgatgctgaccagggccagcacttcatgaacgatcgactccagccggtggacgctgcgtcggatccgctccaggaggtcggtgaccggctcagtcagttcgtcgtcgctcaggcccaggtcgacgtagccgagaatcatcgcgagcgggttgttgatctcatggcccagcatgccgatgaggtcggccttgagctggttggccgcctccagctcacggtggcgctcggctagctgccggtgggcctcgtcgcgggcggcctcggccgcccggcgggcgctgatgtcctggaagatgctgatcaggtgacccgggcgaccgtcggcgtcacgtaccgcggacacggtgacgtgcgtgggcagttgggtgccgtcggcgcgcagtagggaaagctcgtggctgatcaacgactgccggtcggcgatgagcgcgctcagctggcaccgatgctcgtcgcgggccggcaccgggaccaggtcggtcagctttcggccggtcagccgctcggacggcatgccgatcatcgtccggaacgccgggttgacctccttgatccggtcgtcggggccgtggatgacctggccgaccgccgcgtgctcgaactgtgagcgcaagcgctgttcgctgtcggccagccggcggttggtggcggcgagatcggcggtgcgggcggcaacggtggtctccagcgagtcgtgaacgatggcgctgtccagcgagactgctaggtgcccggcgatgagccgcacggtttccaggcggtcggtggagaagaccgcgggctgctggcggttctccagcaccaggacggcgtgcgcgacgttgtggcttggtaccggaaccaccagcagcgagcagatgtccaggccagcgaggtacgggtcgcgggcgaagcggtcgtcccggcaggcgtccgggaccagcagcggctcgtgggtgcgcaacacgtaacggatggcggacagtgggagcctgtggtccgtgtggatgtccggcggggtcgcggcttgcgggtctctgacctgggttgccccggtgatggcgtccgcgccggcaccggtgatggtcgaggcgtaccactggccggtctccggattctccagtacgagatgcgcgtcggtcgcaccggtgatggcgctgagcacctcgccgaccctcgcttgcaggccggccacggtgctctgcgagccgagggcctgtgcggcgcgcaggaccgccatgaggtcgatccccgggaattcggcgatgcctgggccgctgccggtgcccggcgcgggagtggcccgcaggaacgggtgggccgcctccatcgcggtgaccttgccgtcggcgccccaggcccggtaggcgtcgcgggcttcgaagagtagctgtctgccgatgtgacgcaagccctgggcgaggtggaacagaccggcccgctcggccagcagcgcgcggtgccagggccgcccggagacttcgctgagtccggcgtcgaattcgcgggtcgcggtggcggcgtcgtcgtacgcccaggcccgctcggcgtcaatcaggtgccgcagcggccggaagttgcgggggcagtcgtcggcacgccgggccagccagtttcggacgctgtcgagttcggcggtgagcgccgggtcgtgctgcccggcgcggatccgggcggtgaggctgagcgcgcgggtcagccgggccagcatggagacgtagtagccgcgcatcggcaagacgtcggccatcgccgcggcggagtgctcgtcgagcgccgcggagtcgtcgaacagcagggcggtgagggcgcgattggcgtggtacgtcgctcgtggcgtgccgagcgagccgatcgccgatcggtatcccgcctcgtcgaagtcggcgtcggcgaacgatccggggcccgcggtccggccctgtagggcgcgaatcagctgctggtagccggtgaggatgaaggtcggcaggcggccgccggtccgctcggcgaaggtcaggtacggggtcagctcgtcctcggcggcttgtagggtttcactgccgtccagcagcgccgccaccagccggttcgctagcatgctggcgacctgcacttcgccggcggccaccagttcgtcgccggcctggcgggccacatcgaggatgtcctcgagcggctggaaccagtgtgctgcctcgcagagcagaatgtagcgggcgatggcggtctccacctggtagccgtgccgctgcccgacctcgacgatgtgctgggtcagccggtacccggtgcggtagtcgtcgcgcaggccgatggtcacacaggtcacggcgctcaacgacccgaccagcgaggcgcatacgccgtactgttcccacaactcgtgcgccttgaggatgagccagtcgtacagcatcggggaatcgctctgccgagtcggggaaagcaaccggttgatcagccgaccggccgccacgatccgcggatcggtcgtctccacttcggcgtcggctcgcggaccggcgccgagctgagcggaccatcggtacagccgttccagacccgcatcgatcgaacagctcaggtcaccgggcgggacgatctccagccggcgcaacacggccaggcccagctcgatggcctccgtgatgctgccccgctgagtgagactgttgatctgattgaccgcggcgcgggccagggtcagcagatccggagagcggcccaccaggtcgtggtagacgtcatcggcgtcgctcaggcggccgagacagtacagcgcggcatgccggtccacggcgatgacgtcgcgcaagcactggtcgccctgccggttggcggtgagcgactcggcgcagccgaacagttgctcggcggccgtgaagttggtcagcccggcgcaatgccgcccggcctcgtgcagcaaccgcgcggccaccgcccgctcccgcggtgtggtgatccggtccgtcgcggcgagatactgctcggctgcctcgcgtcggcagtcctcccggcccgccaactgccgggccatgtcaagctgcaggtcggcacgctcggcggccgacatgccgtcccgggccgcctgcatgatgaggtcatgccggaagcggaccgtcccggccgggtccatggtgatcatccggtccgcggtggccgccgcgaggtgccgcgccagtgtgctctccggcatctggagggcggctcccaacagcgttgggcgagcgttgccgccaaggcaggccagcgcgcccagcacccggcgggtgggctcgggttgctggccgatacgtgtcgcgagaaggtcggggacctggtaccgcgcgatgaacccgcggacctcggccggatcccagcgccatccggtcgccccgagcgtgagtaggccctcggcgcgcagggcgttgagcatctccaccgtggcgtacgggttgcccctggtgcccgcgctgacgagctcggccaggtcgagggcggtggccggcgtcatccgcaggacggcgccgacgaggtcggcgagactgtgcggcgcgagcccgcctaaccgcaacgttggggatgtcagaccctgcgcggcccagcgtgtcatcaggggggtcagggggtgaccggcgtccatctgctgatcgcggtaggtgcccacgacgagcagcccggggatcggtccggccgagatgatggcgtccaggacccgcatctgggagctgctggcccactgcagatcgtcgatcgccagcactatcgggcgccgtccggcgaccacccgcagcagcccgatgatcccggcgctgatccggctcgaggcggtgcccggatcgtaggagaatgtctccgccggtggcccgagcaacggggccagctcgggcacggccgtgacgacggtcgcggtgttcgggcccagcgtcgcggtcagcagttttcggtcggcggccatcgcgggctccggttcggccagcaggaggccggcgacggcggccagggcgcggccgataccgccggtgccggtgccggcccggaactggtcgtacttgccggcggcgaaccagccgccccgggctgtcaccctcggccgcagccccgccaccaggctggtcttaccgaccccgggcggcccggcgaccagtacagcggggccgccgccggacagcactcgctccagcgccgtgtccagccggcgcatatcgtcgtcccggccgaccagctgtgccgggccggacagcaccgccgggaagtcacgttcgcccagcagccatccggtgtccgggtcggcggtcaaacgccgcaagtcgtggccgagggcctccgcgctctgataccgacggtccgggttcttctccagcagccgcatgatgatcgcgccgagctgccggggaatccgcggatcacggtcgccggggaaggccggtgtccgagtcaggatgtcgcgcaccgattcgagcggctcgtcgccgggaaacggcgggatacccgtggccagggcatacagggtggcgccgaagctgtacaggtcgctgcgccggtcgaccggcaggcgcagccggccggtctgctccgggggcaggaaacccagggtgccgagcggttcttcgggcggcggcacaccggctgctccgtcgtcgagcaggacggccagatcgaaatcaaccaagacgggacggcccaggtccgggatcaccaggttggccggggtgatgtcgcggtgcagcacaccggcctgatgcacagcggcgacggtgtcagcgagctggcacgcgacctcgaccaggcggtgcaccggcagctggacaccgggcgcggcgggaacgccgtcaacctgcagcatgaggacctgtcgtccctgccgggccgccagcttcggaaccccggcaacaccgtcgaggtgacacagcacgcggcgctcgtgctcgattcgccgaaccgcccccggccccgaggcgcgcttacagatcagcgggtcggtgccatcggccgcgctctggagcaagacgtgcgtccggtcgctgctgtacagcagctcctctgccataatcggatgatctcacccatgggatgatcattaacattattgagggctttcatcctgcgtagcgactcacttcgacgtggtgcatgtggaatggcccgcacgatgacagccgcgcgacgcgggcagtaacgcagctagtgcctcgtctttgaacgttggccgtgtaatccgtcggtctgaagctgctcagggcaggctgtccctctcgctgtttgtgggaagtgatgccgggtgggccgacgcccggaagtgttcgtgcaggcgctgtcgatggctgaggaccagcggctgcagaagatcgagcggaccccgaagaatccggtcaatgacaaagaccgctctgcgggaacccggtcaacgcatcacgcggcgggacctgcccactgcgacgaaatgacctccccacgtcgtcccgtgctcgcggctctcggcagatccgcgcaccgtcgccttcacctcctgcgcgattttggttacacgcctttttccctgcgtgcaacttcggcgcaggcggtaattctgcgtgtcccggtaccgatggtgtgagcggaagcagaattgtcggaggggatgtgaacgatgatgaacaatatattttctcatttgatcgggctggcaccccacgccgagttggcaccacgatgaagatgacggttgccagcgatggcgacgttggtcgttgccatcgccgcggcttacgggggctgccaccatctatcggtcggcgtgaccgcgggtggtcagtgttcgcagccggggtcggccggcggtaggtcggcgtcgttacccaggacggcgagtaaacggtagatgcaggagatcacctcggcgagctgctcgggcggggtatccggatcccagtgctccatcgcgagccgggaaacagtgcccacaagcgcagccagcaactgcggatacaccgcctccggaggcagcccggtgcaagtgcaggcccagcggaccacctcggcgtcgaagatctcgatcgcggtgacccagcgttggcgcagcgccgggttagcccgcaccagccgcatccggctggcgaagtcggccggatcggccatcaggaattggatgtgtaccgcgcacaggctgttgagcagcggttcatccgccggccgtgcggccagcagagcggcgagcgtgtcgagccgggacgggtccggatcgaccagcgccgcctccttggagtcgaagtagttgaagaaggtccgccgcgacaccagcacctcggtggcgatgtcttcaacgcagacctggtcgaagcctcgttcggagaacagtctgcgggctgcatcctgcagcgagcggcgggtttgccgcttgttgtgctctcggcgcccggtcaccccggcggcctaactgcgtcggctggccgcgcgggccagcgttcttccgactgcggcgagtagttccacggcggtgaacggcttctgcaggaggccggtccccgcgcggaggtcgtaccgacggcgtggctcgtcgtcgcggtaaccggacgtgtacaccatttggaggtcgagatgacgggcacgccattgatcggcgatcggcgggtcggatcgggaacgcagcatgatgtcgctgagaagaatcgcggagccggccctgtcaacgtcccctgcggcgctcccgtcgagcggagcggtgtggtacctattgtcgtattggatccgaaccaccggctcccggatccgcgcggtggcggcgaatgccgggccgatctccaacatgccgaccaccggcaggcgccccggaacgcacgccgcgggaatgccgtcgagagcgacgaccgccagttgccgggaattggtcatcccaggcctttcgatgaggccggagtactgcggttgttcgataacggccagactagaccttgctccaccatgccggtcccgcttccggggaagccgatgcgatggggctcgcgatgacgcgtgagattcgtgatcgggccggtgccggactggtggcggtggcggttctcggggtgctcacagcggcggcttcgctgccgtggggcgcccgcgggtggctcgccggcagcatcggcggcgcggtggtggcggtcgccgcgaccgtctcctgtctgcgcctgcgaacggtgccgggaataccgtcctctgtacgacgtttctggcagctgtgggcggcgtcggccgccctgttgttcgccgctaccctaggcgccgcagtgggcatcgtccgcggagacgccggcatgcaggtgtacgaggccgttcctgcgctgctcagcgtggttgtcgcggtcctggcgttccgatacacccggctgggtcgccgcaccgcggtcgaccggatccggctgatcctggacggggcggcgatcgccgttgccggcgccctattgttcggccacgtggtcatcggcctggcaccgccggacactccgctgctgagccgctggacggtgggtgccgtcggggtgggttgcctgctcgcgctggtcgtgttcggccgggcggcggccagcccaggtggccgggtcgatccgggtgcgctcggcatcctggccggcgccccgctgatcgccctggtcacggccgtgtcgtatctaagtggcagcgaaacctcgctgatgctgctgtcgatgctgggatatccgctggtggcgcttgcgatcggcggagctgcgcaccgtcaggccgtggtcctggcccgggccggtgccggccgcgccggccgccggccgcggggctcactcctgagcccggtcccgttcctggcggtggccggcacggtcttcctggtcgtcgccgtctcgtcgcgcgacctcgacccgcggggacgcgcggtgctgaccggcgtcgtgctgattgccgcgctcgtgctcgcccggcagttgctcaatttgcgcgagaacggcgaggcgctacgcgacatccgtcggcagcaggccgaactggagcagatggcggtcaacgacccgctgaccggcctggtgaatcgcagcggattcaacctcgccttggctcgccggctccgcgaccggcagccggtgacagccctggtgatggacgttgacgacttcacgagagtgaacgacacactcgggcccgcggccggtgacgtgctgctgggccagatcgccgagcgactgcggaaggcgtgcgctgccggagagatcgcagcccggctcgccggcgacgagtttgcggtgctgctgccctccgccgaccggtccgccgctgacctggcagccgcccggttccaggagctcgtacgccgcccggttagcctcggtggccagcatcttctgctgcacgcgagtatcggcgtggccatcgcggtgcccggggagacggccgacgaggtgctgcgtaacgccggcatcgcaatgtccgccgccaaggatgtcgggcaggcctcctacgtgcggttcgagccgggcatgcggcacaacctcaccaatcacgcgcggatcgccggcgagctacacgacgccatctaccgcggtgagctgcgactgctgtatcagccggtgttcgatctggagaccgggcgcctacacggcgccgaggcgctggtccgctggcagcatccggctcgcgggttcatctcaccgggcgagttcgtcccggtggccgagcgttccgggttgatcgtcccgctcggcgcatgggtactgcgcgagtcgtgcgagcaactggcccgttggcggcgccgatacggtgacgccgcgatcaccgccatcaacgtcaacgtggctgtgcggcaactgcgcgagaccaccttcgtcgcggaggtcgccgccatcctcgccgccaccggcctggagccgaacaacctcgtcctggaggtcaccgagtcgtcggtggccgatggctggcgggtacgggagacgttgcagtccctgcatgacatgggcatccggctggccctggacgacttcggcaccggccactcatcgctcagcctgctacgcgccttcccggtggacgtgctgaaactggacaagtcgttcgtcgacggcatcgccgacggcgcagaccgtggccgtctcgcggtcgccgcggcggtcgcccaactcgccgaacacctgcagctgaaagcagtcgccgagggcatcgagacgcaggcccaacaggaccgtctgcgagacatcggctaccgctacggtcagggattccacctggcccggcctctgccggccgacgagtgcgcagcgataatggccggtgaaacggtgcctgccgcgcggcaatagacatcacgcggcaggctgaggtgaccatcagtgcgattcattgtgggcagccgacagcgtggtcaaggactatgacgctgttcgcaacgggctcaccccgccctggaacagcgcacgggcaaggcagaagtcggcaggcttaaaacgatcggcaacagtcgacgaactttcgctacgcaaccgtagcgtaagctggtctcatgaacgccctgccccgaccggcggtcgaacgcgtccagccgccgaaagccccctatcggatggtcaaccgtgcgatgcggtggctgctcagctcgccgggccgcgctcggcggatcgggcaacatctgcttcttctccacgtcacggggcgccggaccgggcggcgattcactctgccggtggcctatcgtgacgccggcgacgggcggctcctcgtgttgaccaactcgatctggcgcgtcaacctgcgcgatcgcggcgacgtgtcggtcaccctgttcgggtcattgcacccggcgaaggcgcagctcgtcgaggatccggacctcgtcgccgcggtgtaccgcgagctgatcgaggcggtcggccacgacagggcaggccgccgcatgggaatccggatcaacgtggaccgcacgcctactctcgccgaattggccgaggcggcacgtcgcgacggcttggccgtcatctacctcgacgtcgcccgatgaccccgccgatcctggtcaccggcgccaccggcaacgtcggcggcgccgccgcgcgctcgctgctcgcagccggattgccggtgcgagtcgcgggcaccgacctgcgccgactccaggcccgcttccccgacgtcgagtccgctcgcctggacctccatcagccggacactttcccggcggcggtcagcggcaccagcgggctcatcctcgtccggccgccggctatcgcccgcgtcaccccgaccctgaacgcgctcgtggacaccgtcgcccggcacgcacccggccacgtggtgttcgtctcggtcaccggtgccgacaccaaccgcgtggtgccccaccaccgtgtcgaaaagcatctgcgcgccacaccgttgccgtacacgatcctgcgacccggcttcttcgcccagaacctggccgacgcctaccgcgccgacatccgcgaccacgatcggatctacctgcccgccgcccagggccgcgtggccttcgtcgacacgcgagacatcggcgacgtcgccgcaacgatcttcgccgacaccaccgctcacgaatccgcggcctacacgctgaccggctccgaagcgctcaccttccacgcggtcgccggcctgctcaccgaagccctgggccggccggtcagctaccagcccgccagcgtcggcggatacctacgacacctgcgccggcagcggctcccgctcccccaatgcctggtccagaccgtcctgcacaccggcctgcgacacgggcaggccgaacaggtcgatcccacccttgccaggctgctgcaacgcgcaccccgcagcatggcacagtacgttcgtgaccatcgcgaggtgtggaagcagcgttgagccggtcaactgatcctcgtgtgctgcgcagccgcgccaccgtgctgaccagcgcgctggccctgctcgccgaacgaggcatcgccggcaccaccatcgaagcgatcgccgagcactccggggtcgccaaaaccaccatctaccgccagtgggacagccaggccgctctcatcctggacgctttcgacagcgtcctggccctaccggaggaccctgccaccggagatctgcgcagcgatctcctgcagctgctcaccggcttcgccgacgcactgcgcaccagcccggcaaccggcctgatgttcgcgctcatcgacgccgcggagcgcgatcccgccttcgccgccctgcaccggagacaggccgagacccggcatcgactcatcctggacgtcatcacccgcggcatcgagaagggcgaacttcccgccgacgccgatcccgacgaactactggaccttctcgccggtcccgtcttccaccgtcgcgcggtatcgggaggaagactcgatgccgcgttcgccgaacgggtagtggactgcgtcatcgccgcttatcggaccacctgagctgacgtggctcggcccgtggctcggcccgtcaaaagggacgagccaagccacgtcggcgccccggtcgtcacggacgtatgccgactgcggtcaagtgtgctccaggccgtaggcggcggggcggcgcatgacttcgccgggccagcgcatcagccgtgagtcgccgcggccgccggttacggctcgtggggtgcggcgggagggccgggtggcgccggtggcccagggctggtggcgttgcggctgatccgtttgagggaggccagccagtcggcgcaggcaccttcggtgccgccgcaggcgggcggttggtctttgcgggccgggatgccgagcttcggcatcggcacgccggcgccgcccgcgaccttgaaggcctggtaccgatgctacgcgccagagcatcacgaaacaccggccaatctaggacggtcactcccactcgccacccgtcagctcgctcggggtcagttgcaggctgacggaatcagatctcgtcagcagtccgaacatcgtcgccggccgctgccaccacagctgcggctcctcgccgtacaacgtgcgatccggacgcccgaacgcgccggtcagagtcgctgccgcggccgcgaagacatcctgcaggaacgcgtcggcctcggcgcctcgtccggccacccgctcggtgaggttgagcaggatctgctgcaccagggtctgctcgtccaagccgacgaagccgctgctgggacccagcccccaaccggagtcgatcaacgcgcccaggtccgggtattccgggtcgaagtcagacatcgaccagctgaggctgtccatgacgtcggtcaggggtgatgtcatcagccatggctcggtcgtcagcagtgtccgtgccgcgtgtagcaccccggcctcatcgagggctcgccagtcagccactgtggcctgccaggccgggctccgtagcggcagatcccgctctcgtcgatggccaagccgtgcgccggcttggcgtagacgccgtcagtcccacaggtcggagcatgacgggattcccaggtgaggcattggtagattcgagccactcgggctgacgaatgccttgtaggcgagcgaagccggcgacgggatctcgaaaacctcccgcagcgcgaccaccgacatgtcggcgacccggcgatactcggcagacggcgccggccacgacaggttcagaccatggttgcggctcggatcgaacgagggcgccggccagccgatacgttccagggcggcggtctgctcctcagtgaggttgggccggtccagcggatcccagccgctggccacttcagcgaggcttcggctgaacatgaactgcacgaagcactcggtgcgctcctgatcgccgaccaagagcgcgccgccgtccggcagggtggcgatgctgccggccagcccgtcgcgaaacgccgtccagctcacttccacggcccggtcatcaactcgttgggggtcagctggatgcccaccgcgtcgccctagtgatcagaccgaatgcggtgttctgtcggcgccaccacagctgcggctcctcgccgggcagtgggtcggtcggccggccgaacttaccggtcagagcggcggctgccgccgtgaaggcgtcctgcttgaacgcctcgatcgccgactcgtccccggcggcctgcggcagccagccgagcttctccaacgcggccgcctcctgctcggtgaggttcggccggtcctgcgggtccatgccgctagccacctcggcgaccacatggtcgtagtcgagcatgaactgcacaaagcactccgtacgctcctcgtcgccgacgatcagcgcaccgctgttgggcagggacgcgatgctacgcactaggccgtcccggaacgtctgccagtcgagaccggtcacgaccactcacccaccatccgttcggcgggggtcagttgcaggctgacgccgtcgtgttcggtgatcagaccgaaccacgtcgtgtcctgttgccaccacagctgtggttcttcgccgggccggggtcggtccggtttcccgaaagcactggtcagtgcggaggctgcgatggcgaaggcgtccagcttgtattcgtcggctgccatgccgcccccggccacttcctcggtcacgctcaccaggatggatgtcaccttgctgctggcgtcagtcttgaagaaggcgcttctggaaccgaagccgtatccggtgtccaggaacgcgctcctgttcgaccgttcggggtcgaaacgggtcaccgtccagccggccttggccgccacctcctggaccgaagcggatagcagtagcggttccaacgacagcagcgtctgtgccacccgcaacaccgtggcttcgtcaacctcccgccactgaaccattcctgcctccgtcatgccgcctgagctaccctaccgactcgttgaccgtgcccggggagcgtcgatgttgccagaggcgaaggcattgcccgggtcgacgccgtcgaacatgaaccggtataccttggcgtccgggacaccgctcgcctccgcatggccttggctgaccagctagcactcgaccttgatgacaccggtgcggatctgctcggcgatcaccggattctcccggagaaacgtctggaacttcgggtcgagtcgcatggtcagctccaggtagggtgcgctgccctgctgtaggcggtcgcggccgccggtgccggcgatgccacccttggcctcgaccacgaccagcgtgggcagtccccgacggtcgtgacccaggccccagatgtcaagttcgccaggcttcgggtcgacgtggacgtcacaggtcaggtgcttgggtggatgtggagtgcgtcgcaggcgaactcccgtccggcgatcatgccgatccggttcgaagccagcgtgcgcaggtagtaagtctcggaccacgtcgtggctgactgctccagcgcttcaatgtgcggccacaactcagggtggtggtcagccgccttctccaggcgcctgcttgtcttgtcgaggttgtcggcgttcgtgtctttcgtggtgacaggctccagcgtctcctcaggcagccgggaatggcggcatcggctccgttgatacggacggtgcaggactagcgttcccggggccggcgtcgaccaagcggtaggtgaaccgctatgtgcgatgccgaccggctcattgtgtccctggcggttggtctttgcgggcggggatgccgagcttcggcatcggcacgccggcgccgcccgcgaccttgaaggccttgtaccgaaggttggcgggcgacgggatctcgaagacgtcgcggagggcggccaccgacatgtcggccacccggcggcactcggctgaacgggtcggccaggccagcttcactccatggttgaccacagtattgtccgggggcagccagccaatctgttccactgtcgccgtctcctcctcggtgaggaaaggacggtcccaccgatccaggccactggccacctcggcggtgacggtgttccggtcgagcaggaactggacgtagcacaccgtccgttctgcgtcgctgactatcaacgcagcaccgttgggcagggtcgcgatgctacgcgccagagcatcgcgaaacgccggccagtccaggtcggtcactcccactcaccgtccatcagctcgttcggcgacaactgcaggctgactgtatcggtcctggtgagtagcccgaacatcgtgggggggcgctgccaccacagatgcggctgctcgccgtatatggtgcgggtcggacgcccgaactcgcccgtcagggctgccgccgcgtcggcgaagacatcctgcaagaacgcatcaacctcccagcgatcctcggccacccgctcggtgaggttgagcaagatgtgctgcacccggctctgtttgtcaagatcgacgaagccgcttctcgggcccaatccccggctgtcgtcgatgaacgcgcctagggtcggacgatccggattgaaactcgacaccgtccagccgaacctggccgccatgtccgtgagggaggttgtcatcagccacggctcggcagacaagggtctgctgcaccgataggtgacagttctagtcacgcggcctgactggccggtggggtcatgatggtctcgtactcgataggggtcaaccgggacagggatcgttggcgtcgccggcggtggtaggtccgttcgatccaggtcacgatcgcgatccgcagctgctcgcgggtggcccaggtccgccggttgaggacgttgttctgcagcaggccgaagaacgattccatggcggcgttgtcgccggcggcgccgacgcggcccatcgagccgaccatctgatgccgggccagcgcgcgttgcagcttccgggagcgaaattgcgacccgcggtcggtgtgcaatacacagccggccaggtcaccgcgtcgagcggcggcgttgtccagcgcggccacggccaggcgcgacttcatccgcgcgtcgatcgagtagccgacgatccggttggaccacacgtctttgatcgcgcacaggtagagcttgccttcaccggtgcggtgttcggtgatgtcggccagccacaaccggttcgggccgtccgcggtgaagtcgcgtctcacgaggtcgtcatgcaccggcggacccaccttgcggcttttgccacggcggcgtttcttgccgaacgcgctccaccagccgttaccagagcagatccgccacgccgtccgatcggccatcggttgcccggcggcgcgggcctcgtcggccaggaatcggtagccgaactctgggtcgtcgcggtgggcgtcgatgagcgcgttcgcccggtacgcctgcgtgagcacggtcggcgtgactggacgggccagccaccggtagtagggctgtcgagcgatgttcagcacccggcacgtcaccgccacggggatcccgtcggcggccagctcgctcacgagcgggtagagccttttcccggcagattcgcctgcgacaagtacgccgcagcccggcgcagcacctcgttctcctgctccagcaacttgttccggcgtcgcagttcccgcagctccgacgactcgctgcgggtcacacccggcttcgcgccgtcctcgacgtcggcctgtcgcagccacttgaacaacgtcattgggtggaccccgaagtccttcgcgatctgctcgaccgtcacaccgtcgtcgcggttacgggcaacccgcacgacatcgtcccggaattcacgagggtagggcttgggcacagcaacatccttccagctcgccgtcacggcaagccatctcagatatcacctatcggtgcagcagaccccaacagcctctgcgccgtctgcagtatcccggcttcgtcgagtgcctgccagtcagccactgtcccgtacctccgttgtcgtcgccggtctgcaccttagcgcctgatcaggacgtcgctggtgggtcgatatcgcgagggcagaaggcgttttcagggttatccggatcgccatagataaaccgggcatactttggcgtgcggcacttggatcaaacctcgttgtcggcgtcgagccagctcatatcgacagactgctcggcactcagcagcggaccctccacaatcccggcttccagcacgatgccgaacacctcactgaccaacctcaacatcgcggtcagagcatccagctcatcgtctggccgatcgggatcaaggccgactgttcgcatggcgtccaggagccggtcaggatcactaccactgcgcgattgcggcatcaacggatcgagcgagcacaccatctggccacccacggcataccgaaagaccgacacggcactgcccgtgcgaagcacctgaacaacccgcgagccacgcgacagcgctacaacgacgtcctcctggctaccgcttctgccgaacaactcgaaagcaaagcgccagccgcccacctcaccgacgcggatcactggcaactcatacccgaactcttcaccgcattcatccagggaaagaacctcggcctcacctgggtcagcgccgaacgcccgcagcaccccaccctcgtcaccgccttccacaaaagtcaggctcaaacccagcgacgagtacctgttgctccaaatccatcgatcgtcgaacgaggcacgcataccgaccaatatagaaacatgctccactggccgtttcgcttccagcacccgtccgggctggttgccatgtcggaccgcaagaccggctggacatcacacctagcccctcgatgccttcggcattgaaccggtagatccatgaacgcaccgttcgcgcgtgacatccgacctgcccggcgatctgcggctccgccgacagcagagtccgcgccgcccctactatcgccgcctcgtcgagggctcgccattgcgccattcgccggcgcccccagattcattgctatacgtcgatgcttttcggtcgaagaacgcctgggcagtgtccatggcgccactacgctggagacgctttccgcccgtatatcggccccgtcaaggaccgtcgcggggctcaggaacgccagtcgggccggtacgggactccgaggcggggcatttgcaagggctcgcctgttgcgctgacaacgaacgctttgtagaccagcgagtccggtgaagggatcccgaagacgacgcgcagggcggtcacggacatgtcagcgatccgccggtactccgccgaaggcgccggccaggcgatcttcaccccgtggttgcaatgctcctgcagctccgggggcggcaaccagccgagcttctccaacgcggccgcctcctgctcggtgaggttcggccggtcccacgggtccatgccgctggccacctcggcgacgacatggtcgtagtcgagcatgaactgcacgaagcactccgtacgctcctcgtcgccgacgatcagcgcaccactgttgggcagagacgcgatgctgcgcgccaggtcgtcccgaaaggtctcccaatcaagggcggtcattcccacttacccaccattcgttcggcaggagtcagttgcaagcctacggcgtcgcgtttggtgaccaagccgagccacgtcgtgtcccgctgccaccacagccgcggtcgctcacccggctgggggcggtccggctggccgagggcactggtcagtgcagacgccgcgagcgcgaacgcgtccagcttgtactcgtcggccgccgagccgccgcccgtcacatcttcggtaacgttcgctgagatcgatgtgaccttggcgtcggcgtcggtgttgaagaaggcgctgctggagcccagaccacacccggtgtcaagggatgcgcctccactcggccactcggggtcgaaacgggtcaccacccagcccgctttggccgccacctgctggatcgaagcggtcaacagcaatggctctagtgacagcagcgtttgcgtcaaccgcaacaccgtcgcttcgtcgacttcttgccactggaccatttacctacctccgtcatttgccgccggaactaccctaacggccctttcagcggcggggagcttcgatgttgccagggtcgaagatgttgccagggtcgacgccgtcgaacatgaaccgggatactttggcgtcgggtacgacaccgtttgcctcctcatgaccttggctgaccaggtagtactccaccttgatgacaccggtgcgaagctggccggcgatcgccgggttgtcccggaggaacgcctggaacttcgggtctagtcgcatgatcagttccaggtagggtccgctgccttgctgcagacggaggcgaccgccggtaccggcgccgccgcctttagcctcgaccacgaccagcgtcggccgtccgtgttcatcccgacccaggccccagatgtcgagttcgccggccttcgggtcggcctggacgtcgccggtcaggtgctcggggcggatgcggaaggtgtcgcaggcgaactcccgtccggcgatcatgccaatccggttcgaagccagcgtgcgcctgtagtaggtcttggaccacgtcgtggctgactgctccagtgcgtcgatgtgcggccgcaactccggatgctcgggggccaccttttccttcagatactggatggtttcctcaagattgtcggcgttaacgtcttttgtggtgaccggctccagcaactccgcaggcacccgggaatgtgaccgaaccgcgtcgaggatcgcgttcaccgagtctagtttcatcgtgcggtccgcactggcggtgttgagttcaacggtcagctcccgatagacggcgctgtccttgacgatcaggtcggcatttgccgcgtcgtgggggtggtccggcagccgttgtttgctgttgacgacgtcccatccttgcggcttgcggaacgggtcgttggaagcaaacccgggccgtccgtcgtgtccgtagttctgcagctttccgttctcggcgcggaaggtgtccaccgggtcgccctcgacgtgcagccgaatcttctgcagcgtctgctggtgagcctccatctgcagaatctttccgtcctgcaaagtcctcggccggatctcgatgccaagtcgctgcgcaaggtcgtcagggatggcccgcagatcatcctcggcgaatcttcgcctctctggtgctgccgggagatcctccggtgcgccttggagcaggtcactaagccgtccggccgcagcgtcgttgaagtggtgtgccgacgggttgtcaagcatctcggtgacagctccccggcgcgcaacggcacccagttcgtcgccacgtaacccgaggtggtcgacgagttcgccgagccggtcgcgcgcgcctgcttctccgtttagcgagcgttcgtgccagtcgagcatttcggcgatccggccgtggtcatccgggctcaatttgcgcgcgccggtgtccttgggaatgagcatcttcttgggcgacatcgtctcgccagccatctgcaggcgctccgcttgcaggatttcggcgagttcatggctggtcacggtggagatgtgctcgggtctggctccagagttggcccgcacctgccagatgttgtctccaccgcgcgtggaggtgccgacgtccttgcgatccatcgactcagccccgaagttgagcttgatttcgtggccctcaccagtacggatgacgtcgggggcaccgtcctcggggcggctgaactggacgttcttgaacagccggtcgaggacctccggtaccgcttcgcgcatttcccggctcaccgacacggtgtccgccggtcggccgaagccgtgatactcgccgccgatgacgtgctcggagtggatgggatccagctgcgggagccggcgtggcagctcgggcagcatgccacgcagtttgtcgatgtgcagcagccggccggtcaggctgggcggacgggaggtgcgcagttcgccgagccgggcggcgatgtcgtcgggcgaggccgggcgccggaccggctggccgtccttgaacgcggggtcggtgaaatgctgttccaccatctgcttgaaccgctggccggtgccgtccagccggtcggctggggtgcccaggacccgttgcaccgtctccggccgtagccgcgcggtgccgtcctgctccggcttgaaccggcggaacagcgcacggtccatcgccgcttggtcagcggcccggttctccgaccagcgctgaattcgctgcgcgtagtcctgccagcgcctgccgtccggctccgacgcccgccgacggggatcatcgtggccgtagtctcgccgcgacgaccggtttccctgatcacgggcctcgttgcgaggcggggtgcggcccggatcatcgtcacgcgtcggccgttccggacggccgccttccgtgttcgtgccggtgatgtccccgcgcggatcctgggcccgagacgacgaggccggctcgcccccttgccgttccggtccagtcgatgaccgtgtcgggctttctgaccggggactggtcgtcgtatcgccgggtgagatgtcagcgggccgatgagcgggcaggtcggttcggccgagttccccggtacgcggcaccgccatttccggtgcgcccggcagtgccggctcgccactggagaatgcggtctctgggactgcggatcgggccgcggctggttcgggaatgcgggggccgccgatctcggcgtgccgcccatacgccggcaccccggcatcggctggcctgccgtcaccggtgccctcggaccgcgctccatggacggccggcgcgtcacgtccggcccccgccgttccttcaaggctgtcgccgtgcacctctcgggtgtgaccgttggccgcatcacccggccgctgcacctcccggcccgggtcagctccgccgtcagagccatccgctgcgcgctccggtacggcccgatccgaacctgcagacatgtcgccgcggccggtgtcgctgtcgttggccgcctcggggaaccggtccgggtggccggtctcctggcggcctcccccatcgggttcgaccacgcgctggtcgccgcgatccgccgtgccgctctggccgccagaagtctgctctggcttgccactcgcctgcggagactcgtcccgcgccgtgtcaccggagccggaccgctgctcaccggtgcctgcttcggcccgctgcggaccgccgcccgcctccgcctgcttcccgccgccggtcgactcgctgcgctggcccggctcggtgcccgcacgatcgcctgattcgccgcgcgactgctggtcggcgcccggactgctggtggagcgttctaacccggtaccggccgacgtctgctcgctgcctccggcgccgtgatcggctgcgggccgtgttccggcctggacgccggtgtcgccggccgaccccacgcccggctcggcgcccggcgtgccgatttcgccgaacgcgttgttctcgccgaggcgtagccgcaggtcggcgccggcgtctcggattccgccgcgcatccctttggccccgagcaccccgccgaacagaccggcggtcgcgacgctagctagctagagcagccgatcctgcatggccagcgcgagcgagccggcgccttccaccggcttgtggtactgctcagcgaacgccttacccgcctgatcattgccccacggctgaccctggtcgaggccttggatgtcaccgaggatctgccgcgcctgctccttgaaatcctgcgcctgcgcccgcaaccgggcaccgatctgcgcgaccgcttccgtgccctccggcaactccagatacgaactcatcgacgcaaaccctcccccagcccggttctcattgtgaccgtcccccgccaccaacgcccaggacacctgtcacaacgtctcaccccgcaacacactcatgatcgacggccgccaccacgacaactccgcgtcataggtcgccaccaccagctcatgccccgccaccagccgcaccaactgcgccccatacggcagcaccagcccgacgacctgacgcgtggcagcaccaccggcgtcgtcctcgtgccaacgcaccagatagccgtcaaggatcccggcggcacccgccggtgccaccgacccggtcaccaggccgccacccgcggccagccattccaacgcccgactcgaatcaaccagagcctggacccggcgcatccgcggcccagccaccgggacatccacggcacccttgtgcgtgggtacggtccggcgcagcaccagctcctgcgcccagcgccacagatccggtacctgggccccggtgaactccgcgaccatcggcgaccccgggttgaccaccatccgataggcggcgccgggccaggcacgcaccaccgacagcagcggcacctcgacaaccgcgggcctgtccgccggatccggtaaccgctgccgtgaggtgaacaccgcgatggtggccgcaccgtcaacccgctccaccagccacggaaagcccggcttcccgagatcatccgcaccggccggaccggccagcggcagcaacacgtccgcggtgaccagcagatcgagatagacctcggcatcaccggcgcgctgcgcggcacgcatcgcccgctcccgctcaccacccggcgcgaacggaggctcggcagccacctcctcgcccagcagacgcacctgctccgcgtccaggtaggcgccgatcggggtgtgcgggctgacggcgagtccccacgccgggttcggccacgacccgaccagctcggcgaacgtcgtgcgccgccagccgacgcccaccgccggaatcgcctcctgcaaggcttccaccgaggtgtagaccagcagaaacgtccggccaccccgctcacgggtcagcagccgctgcccgctcgcaccgtcatcggggaagcccggcaaaaacaggtcagcatgcagcagtacgtcggcgaaactgtccgcgtcgtcatccgcccacgctcgcgccagccgccgctcagcactgttcgccgctgcccacgctgccccgcccacaccccgcaacctacaacatcagatcatcgacagatatcgaacgctgctgcgggacggcctgccactcggcacgcatccgttcaggaagcgccgcaccggcaagctccggccgcacctcacggaccagcccgccgaccaccagatcctcgaccacctccagcagcaccgcagccggccgccgcaaccccgcccagaactcgtcgaagtccccggcgcagcgccgcaacaaccgcccgcagatctccgctggccccagactgtcgtcatcacgcggatcgtcgtcgtctaagaaccacacactgcccgcatccggaccagccacccgtatcgcgaggatcccgccctgcacaaacccgaccggcaggacttcgcccgtgaaccggtcccccagccaccgcggcgcataccccagatcctgcagcatgtcgtcgcggcccaaaccgaacagcggctgatcgaccaccatccccgcgaccgccgacactgccggctcggccgggcccacaccattacccgccgccagaaaacgccgatacgccggcggcaggccgtacccgagcaacgcctccacctcggccacgatcggttcaggaaccggctcgaccaccacgcgccccaccggcgccatgccggtccgcacgccgaaccccggccggcccacaggcagggtgcgggcgccaccaccatgccggaacgcgccgtgcaactcgaccggcaccaacgcgacccgacgcgcctgatcatcgaacgtcggcatcctggcccagcaccagccggcaggtgtcggcgtcgccccgggggaatctgactgcgcatccggccaaaacgggtcggcaccccgcatcacccgattcgccgccaacacgtcgaagaccagctgctcatcaccggtcaactcggctatcggcgccggcaactcgaccaccgcacgcgcatacaacacccaatccggaaacccggcggcatcgatcagcacaccctgccgatagcgcacccgaagcccagccggacccggatgcaccaccgtcatcgcccgcccagcacccggcatcaccggtcggtcacgattcccggtcggcatccatgatccgcttcaggtcgccgtcatgcgcccgcatcaactcccgcaccccgggtggacgctgcccgcgcggccccaaaaggtcgtcggccttcggcagccgcgcatccaccaactcccgcgtctgctccaccgcctgctccaccgcggcccgcgccgtcgccagaatcgtcgccgccaacgcacccgcattcggccgccgatacacccgcggatcaatccgcaaatccaccaactggccccgcggacccaccaccaccgtcaccagcccatccggcgacgtcgcagacccggtgacgctcaacacccgccgctgcgtctccgccgcatcccctaacgaacgccgcaactcctgagccaagctcagaaaagccgacggatccgtcgcacccatgccaccacctccccggacatatcagtaccactaacagaccaggccgatgcgcttgtaggcagtctcgtcgatccggttgaggtgctggccgacgcaggctaccggcggccggccagacgatgctcatcatcggattggtgaagcctgtgacgcactcgtcccttcgcagctttcgacatcggcccggatgcgtggcagtgaccctctgaacccgagttcagcggcgttggtaacccagcgaatgacctggggatgactgcttccgggggcacactgcccttggcatggtcagcaacggggtctgccgcccgggctgaccatggacgcactgacgggcgtcatcaaaggcacgccgaccacggcgggcacctacgcggttaaagcgaccgcgaaagacgcccgatcaagatccgcagctcattgacctaagacagagccgttcgtggcacagtccccccctatcccaggggcgtgaagtgcaccggctccgcccgcgaagacggagccggtccggggataccggcggcacaggtcggccgaaaccattccgggggcagacggttcggtcgacgatcgggcccgccaccttcgcggctcatcgacaccggaaggggcagtgccgggaatggcaaaacgggcgatcaccgagctggcgaatggtggcaaggcccgattccgtgcggcacaacgacaatcttacgctacggggccgtagcgaaagctatcgggttgcgtcggtcagcgccgacagctggtgctcggcgtcgcaagccccgaaagcctgagtccggtcgccaggggaatcacgtgatggcgacccggatggtgtccaggttcgggtctgcagagtcgggcaggaccatgccggctgccaggccggaccgcagatagtccaggatctcggcattgatccgttcaccgggtagcagcgcgggaatgccgggcgggtatggggtgatctgctcggcgcagacccggccggtcgcctgcgcgaccgggaccgtctcggcggggccgaagaaagcgtcccggggcagcatcaccgggtccacctcgaacgcggcgggcggcggcaggtgcaccggcttggctgccggcagggccggggcggcggcgaccaaacgccgcagggcttcgatgagccggtcagcggtggtctcgtcatcggccatcgagagggtggccagaatgcgccgatggtcggacaggcccatgtcgatccggcagttctcgcggagccagtcggctgcctggtaaccgctgatcccgaggtcggtcagatcgattaccacctgcagcgggtcaaggtcatggctggcctcgacactgatcagttcttcgcgtacgacgtgcaggccggcgattcgtccgatgcggtcccggacactttcggcgaccctgatggcggcggacagcaggtcatggccgtgctcgaccatctggcggcgccagccgtcgagaccggcatagacgatggcgttcgggctcgtcgtcatcagcaggtcggcgcatgccgagaggtgcttggcgtcgaccaggtcgccccggctgtgcagcaccgacccctgctcgaagccggcacccatcttgtgcacgctgaccacgcagatgtcggcgccggcacccagagcccaggtgggcaggtcgtcatggaagggaagatgcgcgccccacgcctcgtcgacgatcagcggcttaccgcggcgatggcagacctcggccaggccggcgatgtccgcacaggttccgtacggggtggggctgacgatcagcgcgccggcggcggtcggatgccgattccaggcctcttccaactgttgcggcgacggcggatgcgccaggtgcagattctcgtcgtaccgcacatcgacccagcgcggctcgaccccggagaagatcaaaccggccacgacggacttgtgagcatcccggccgatcagcagctgcccccggcccccggcgacagccagcatcgccgctttgacggacagggagcttcccgcggtggagaagaacgactggtcggcgccgaccgcgtcggccatcagcttctccgcctcggcgaggtactggtgcgacgaggaacggtcgtcgagaccagcggacgcgagcacatctgcctgataagtcgatgcccccaggatctgccgggctcgcgggtcggcgccgcgcccctgacgatgtccgggcggggtgaatccgtacctgtcctcgcggtgatagtcgaccagcgcctccagcagcggggcacaggcgtgatccaagatccggtccttcatgccgcacatgtaccaccgggcgagggtcccaaacgactcgagccggcctgtcacccgcccggataccaccaaggtcgtaggatgacggccatcgcagcgaggtggagcgatgcggcacgctcgtcgcgggcacatcgccggttgatccgcggcgtggcagcgccccgccggcgatatcaccggccgctgggcacggctccgtgaatccgcgtcacgtaacgccgataggccggcaggccgaaacgggagaagacgaagcgcaccggagcgggcatctgcgccagaatgccggcccgttccgctggtgtggcgtcctgcagcatcaggccgaggaagacgaagccctgacgcatcggcatgctgcgccgcccccggttgctcaactgccgccactgcgccacggtgatgtgctccgcgaccaggggcagcaggttcgcctcctcgtcgtccagatgctcgaccagcacggcgtgcagggcttccagagcctgggcgagctcctcccgcagcacgacatccgcgccggccccccagcgcggcgccagccggtcgacctcggccagccagccggccgccgcctcgtgctgatgctccatccgctcggtcacctcggtgctgacaccggccaaccagggccacagcagcgcgtcctcgtcgctgtgatgatggtgcaacgccgtggtcagaaaccggcaatgcgcggccagttccgcggaacggtcaccgtcgccgtcggccacaccgcggaccagatccggcagcagaccgacctcgcgccggaacactcgatgcacgatcaccatctcgttggtgtccggccgttccccgatgcgccccacggcgtttccttcctcatcacgatgaaccggcgaaaagctcgccagatccgacgccgccacctcagacggtcgcgggaacgccgtcgagctcgtcggcgatgccccgcacgatcggctgcagcagagcgaactcggcgcgcagcgcgtccgcggtcgccgtcggctcggggagctcgtcgccgctgcgggcggcgtgttccacgtcggcgagcaggccggccagggtggtggcgccgagattggcggcggagcccttcatggcgtgcgcctggtcgcgcaccggtcccggctggccggcggccagcaggtcgcgcagcgtgctgatcccctcgggcgtcttggtgagatacgacgtcatcaaccggctgagcagccgactctcgtccgggccggggtcaccgccggtaatggcgagcagccgggcgcggacctcccgttcccgggcgtcgcccgcggcagcctgctcggctgcgccctgggtgggttcggcgcagccgagcgcggcggccaggtcggccagccggaccggtttggccaggaagtcgtccatcccggcggcctggcacgccgcccggtcctcctgcagcgcgttggcggtcatcgcgatgatccgcggttgcctcgtggcggggatctcggaccggatgcgccgggtggcgtccaagccgtcgagcaccggcatctgcatgtccatcagcacgacgtcgtagtcggcgcgctgcatcgcctgcaccgcttccaggccgtcggcgaccgcgtcgacccgatgcccgagcttggcgagcatggtctgcgcaaccttctggttgatctggttgtcctcggccagcaggatccgcagcgcgctcaccggcttgacggccggctgcggcgtgggcgccggcgggatggcgccgtcgggctgcggactgagcagctgcatcagcgtggtctgcagcgtcgcgggccgcacgggcttggacatgaccgcggcgaacacgtcgcgctggcccggctccggtcgccacgtgacgctgctgagcagcacaagcggcataccgcggccggcggcgtgcgagtgcagcaggccggccagctccagaccgtcgacgtccggcatgtgcatgtccaacaaggcgacgtcgaatcgtgcgccggcgtccagggcggcaagcgccgcgtccgcgccgtcgacggcggcacacgtcatcccccagccggcgagttgagcctgcagcacggcgcggttcgtcgcgttgtcgtcgaccaccagcacactgcggccgaccgtcgaggagaccgtcgtggcggccgggtccgggcaggcgcgcaccaccgcggtcgtggtgaaggtcgaaccgacgccgggggtgctggcgacggtgatgtcgccacccatcgcctgggcgagccgcctgctgatcgccaggcccagcccggtcccgccgtacagccgggtggtcgagtcgtccacctggctgaacgagcggaacagccggtgcagacggtcggcgggaatgccgatgccggtgtcgcgcaccgcgagacacagccgcaccgcaccgtccgggccgggctcgtcctgcgcgccgacggtgacgacgacctcgccggcggcagtgaacttgacggcattggacagcaggttgaccaggatctgccggagccgggtgacgtcgccgcgcagtagccgcgggcaggccggatccacctgggcgaccagctccaggcccttggccgcggccggaagggtgaccagggccagggcgctgtcgatgcagtcgcgcagctcgaagacggcgtcctcgagctccagctgccccgattcgatcttggagaagtccaggatgtcgttgatgatgaccaacagcgcctcaccgctgtcgcgcacggtgctgacgtactcgcgctgctcggtggtgagcctggtgtccagcagcaggccggtcatgccgatgacggcgttcatcggggtccggatctcatgactcattgtggccaggaacgccgacttcgacttggccgcctgcaccgcctcgtcgcgggcagccagcacggtctcggtggcgatggtgaccgcctgggccatctcggccagctccgccgtccccttgatctgacgctgcgggccctgctttccggcgatgaccgaacgggccgcggccgtcacctcggcgatgctccggttgacccggcgggtcgcccacccggtgccgagcccgaccagcaaggcggcggtcagcgacccccacaggatcacatggcgggtctgcgcgccggcggtgccgctgacctgcaactggtggtcgagcagctgctgttcgtgctcccgcatcgcctcgatggcggcgtcaatactgatcatgtcgtcagcgccgcggttggtctccaccactgtctgcgccgcagcgaacccccgggtgcggcgcagctcgatggtgtcggccagctcgtcgagcttgtcgcgcagcggggccgacaccgagctcagcaaccgcgcctggatcgcgtcgcccgcggtgagctgcccgagggtccgcacggtgccggggatggcggcgaccgccgcggaatacggatccagatactgctcgttgccggtgatcacgaagccgcgttggccgcgttccgcgtcatcgacctgcttctgcagcatcgccaactgaccgaggacgcagtgcgcctgctcgaccggcacccggtcgccgagcagcgtgccgatccgcacgaacgcactgccgcccacgatcaccattgtcgcgaccgcgcacaggtaactggcggtcagcatccgcgcgatcgtccagtggcgcagtctgctcgccgtcgtggggccgggtgcgggccggccggtcgaagcggggcgagaagcggtcacgacggatcacatcgtccgccgccgcaccgaactgacctgaacaaccgaactgccactcggtggcggcgccgcatcgctcaggattcgtcggtggtgcggcgtgatcgtgttccggcctgtctcgacgacacccacgtggcgtggaccgcccgggccgctacgtcgtccggtatccgttgagggttccgctaccgggcacggcgtttccgggcttcccggcgccgctgtggtgctggggcagtcggagggtgatgcgggtgccggggcggtggtgagggtcgtaggtgatggtgccgccgtgggcgtggaccagggcgcgtaccagagcgagacccaggccggtgccggggatgtagctgtggcgggtgttgccggcacggtggaagcgggtgaacagctgttgatggtcttcggcggggatgccgatgccggggtcgacgacggcgagttcgacgacgccggtgtcgtgctcgtgggcgctgatccggatgtcaccgccgtcggggctgtatttgatggcgttggacagcaggtgatcgatgatctgccggaggcggtgcgggtcggcttcgacgagcagcgtggggggcatgtcggtgtggatgcgtcgttgggcgtcgacgggcacggcggtgaccgcggcgttgacgatctcggtcaggtgggtgggacgcagttgcaaagaggtgttcccggcttccagaccggcgaggtccagcagttcgtcgatgatcgactgcagagtgctggtgttgcgggtgatggcggcgaccacggcgcccagctccggttcgatgagctcgtcggcgagcagggtgctgtagctgatgatcgaggtgagcggtgtgcgcatctcgtgacccaccagggtgaggaaatcgtccttggcgtggaccagctgcgcctgcagctcggcattgcggcggtggatgaggaattgacccagctgtgcggtgacgctggtgagcaggccagccaagagcactctgtcgcactcggcggtggagctcagcgacaccaggacgccgaggatggtgtcggcgtcgcggatcgggacggcgaggctggcgcgcaggccctggtcggcggcggcgcgggcgatggtctgcgcggcatggcgggcgatgaggtgggagtcgaccaggtcggacagcggcagtggctggtcggtgcggcccagccggcgggtctcggcgtcgccgcgaccgatcatgtcgggcagcagaccgcccacctcgacaccgggggcactccagcaggcggccacgcgcagcacgtcggccacctcgtcgatcagcagcaacgcgaggtactgccagtgcagcgcctcgccgacggctcgcaggatcggtggtgcggcctcggcgatggtgtcgcagcggttgaggatcccggcgacgcgcaattcgcagtcacggaagcgttcccggcgacggcgatcggtcacgtcctggacggtggccaccgccccgagcaggtgaccggcggcgtcgtggatggcttcggcgttggtgagaatgtgccggtcgggcatgtccggcgcctgcatcaccgcccggacgtcgcggacactgccctcgcgcagtgcgcggaccgtggcgagttcgtcggtcgcgtacggtgtgccgtcgaggtggcgcaactgggtgtaggcgccggccatggcttcggcgggggtcaggtcttccggcaggccgtagaactggcgcagagtgcgattgaacagcaccgggcggcggtcggtgtcgacggcgaacaccccgacctgcaggctgtccagcaacgcggtgatgaagccggcttgcacctcggcgtggaccgtggcactgaccgcagcagcgggggcgtcggcggctgagccgctctgatcaagatcggtgagggcggccatcgcgatgaccggatccgcgccgaccgggacgggcccgagcatcgcggtgatctccaccagcgtggacaggtcggtctcgctccagtcgtgcggaccgtcgtccaggacggagagggcgccgacctgccggtcctggccgtcgcgtagcgggacacccgcgaacgcgcggatgccgtgaccggtgaaggccggatgctcggcgaactgcgggtcggcggtcatgtcgggtaccgccagcggcccgtccgcagcgaccacgttcgcgcataccaggtgttcgccggtgcgtcgtcgcgctgccggggatgccggtagaccgaacatgccgaggaactcctcctgctcggcgccgaccaggctgaggacggccatgggtgccctgagcaagcgtgctgccatgcgggccagcgcatcgagcgggaccggcatcatcggcagggcccggtgggcgccggcaaccgcctgcaatcgcgatggagacttcagcactgcgtcgttgcggtccgtcacaacactcaccagctctgagcgacagggccgggagcgtttcccgaccgtcagatgagactacgatccggcaaccagcagaattatggcaaaatcacagttttcgccttcccgaatgctgcggcgatcggggtggccccgcagcggccgccagcggcggcattgctgcccaggctccgacgccgagacgtgtcggacctgagactgccgcggtggaaggcgaaatcttgttgcgggagctggggaatgttgggacggtgccggtccccgcaatacccgtgaggattccgtgacgatctttttctatggcgccgaagaggtgccctatgggtgcttctccaacttctccggtcacggtttcgaccttgacgggtcgtggtggccgacctcggagcactacttccaggcgcagaagttcaaggggagccggcacgcggagctcgtccggcgcgcccgcaccccgatgcgggcggcggagctgggccgggaccgggcgaaaccgctgcgcagggactgggagcgggtcaaggacgacgtgatgcgccgcgcggtggcggccaagttccgcgtgcacgccgatatccgggacattctgctggcgaccggcgacgaggagatcgtcgaggacaccaccaccgatcactactggggtcggggcacgaccgggaacggccggaacatgctcgggctgattctgatgcgcacccggagccggttgcgcgccgaggcatgacggcggtaccggccctggcgtaaaagcttcaaccggatgttcagcggtacgattcatgggcatggcaccgatcgatctgaccatggacgagctgcgcgaggtggcacggtacgccgtgcggcacgccgaagtcgtactgccaatttttgagcgaaccgtgcccggggatcaccgtccgcgggcggcggtcgatgcggcgtgggtgttcgtcaacggcgagcggcgtacgagactgcagcgtgtcgctgccctggacgcccatcgggcggcgaggcaggcacccaccgagcccgcgcggctggcggcgcgggcggccggggacgcggcggcggccgcctatctgcatccgatcgcccaggcgtcgcaggtgggtcacatactgcaggctgccgcgctggccgcccggctcggcgagattgaatccggggccgatccgcgcgacctgctggaacggtcgcggcagtgggcgacgccggtcgtcgtcgacgtgctgaaccggtatccgcggatcgagggcgccggattgatgggtgacctcgacgcgttgttgcggtacgacgcatgattctgccgaaggttcgcgatccgcggttcgtgaccatccgccggggcggcacgctgaccgatgcggaccatcatctgctcgcgctgtgggcggccacctgcgccgagcatgtgctgcccctgttcgaggcggagcggccggacgatccgcggccgcggcaggcgatcgagcatgcccgggcctggacgcgcggtgaggtgaggatgatgcgggcgcgagaggcgggcgggcatgcgatgggcgcggcgcgggatctgcgcggggcggcccggttcgccgcgtacgccgcgggtcaggccgccgtggtcgcgcatgtcgccgcgcacgagctgggcgccgccgcgtatgcgatcaaggcggcccgggcggccggggatctcggtgagtgccgatggcagcgggcccgactgccggcggcgatccgcgagctggtcctggatgatcagcggttgcgcaacgacatctgctggtcggtgttcaccgagtgaggggccgtccgaccgcggcggagacttcgccatgccgaattcctcaatacggagtgtgatcgtgccgacatgctcagcatgatcttccgcccggctgcggtgctcctgtcccgactgcgctacgcgcagaagatactgctggtcgccgtcgtcctgctgctcccgctgggtttcgtgacgtgggggtacgtggacatccagcgcgggcaggtccgtttcagcagcaccgagcgcgacggcgtcgcctacctgcgtccgctgctcgacctcaccgtgcacgccggggacgcgacgcccgagcgcatcgcggcggtcgacgcggtggatgcccgctatggtgcggctttcgagagcacccagctgtggacgacggcgaaggcggcgctcggctcgggtcaggcgaccgacgcgttgctggccttgatcaaccgggtgtccgacaaatcgaacctgacgctcgaccccgacctcgactcgtactacgtgatggatgcgctggtcttccggctgccgctgctgttgagcagcgtgcaccaggcgggcatcgcgtcagccgcgggtgacaagatcgccctggccgtcgcgaacggtgcgctcgacaccacgaaggcggcgttcgcgaacgacatgaccacggcgtatgcgaacaccggctccgcagggctgcgcgcggccagggacgtgacggacgccgtcctggccgatcccggtacggacagcatcgccgccgccgacgcgcggctgattccggcgctcgaccagctactggtcgcgcggatcggcgggttccaggcgaaggccttcaaggtcgaggccgcggcggcgctggcggtgctgctcgtcgcgtatctgctcgccgggttctaccggtccgcgacagtgccgatgcgacgcatggtcaccgcgttgggtgccctggccgacggcgacctgaccgcccgggtgcaggtcgacacccgcgacgaggtcgggcacatggcccaggcctacaacgaggcgctggaccgggtccggccggcgatcgaggcgctgcgcgacgaggccgccgacctctccggttcggccaccgaactgacccgggtgagcgaccggctgcgggacaccgccgcgcagaccgcggcccacgccgggcgggtcagcgatgcagcgggccaggtcaccggcaatgtcggcgacctggccacgggtaccgacgagatgaccgccgcgatccgggagatcgccgtcggtgccaccgaggccgccggggtcgccggggacgcggtgcgggcggcccagggcggcaacgaggccgtggcccggctgggccgcagctcggccgagatcggtgaggttctccaggtgatcaccgccatcgccgaacagatcaacctgctggcgctgaacgcgaccatcgaagccgccagggcgggagaggccggtcgcggattcgccgtcgtcgccggcgaagtgaaggagctgtcccaggagacggcccgggccaccggcgacatcgccgcgcgggtcgaggcgatccagagcgacacggcgcaggcggtcgccgcgatcagcgacatcggcgaggtcatcgggcggatcagcgagatccaggcgaccatcgccgccgccgtcgaggagcagacggcgacgaccgcggagatgggccgcggcgtcggtcaggccgcagcgggtgcggacgggatcgctgacggtctgacggcggtggccaccagcgccgaagagaccacagcgaacgccaccgtcaccgccgaaacggccaaccggctgtcggcgacggcggccaacctgcgcgacatcgtcgaccgcttcaccaccagcgaggcactgaccgccggccgccgcgatgccggatgacccattctccccacctgtcaccgctgccggtgaccgcggcgaagcatgcccggggtggtcctaacctgaggtcatgtcgtatgtcgccacccgcgacggccgccgcgatcgcagtgccgtccgccgggctcccgccgtccccgaccggatcgacgacctccacggccacagcgtcggcgtcctcgaagtcccgcatcacatggcctgcggtcacgccagccgtcgccggtacgatctggaggatccggcccagctgcggcacgcctacgagcaggtgctgtgcgaggccgccggctgcggcgaggtcgaagacctgatcaacccggccatgctccgtcgggtgtggcgtgacctgcacctgccgtcccgggtccgggacgcctgggagacccggcatcccagcctgcgccgcacgatcaaccgcagcccgtccgccgccaccgcggagccccggcccgccggcggcggcttcgcccgccgcggccgcacccagcccgtccggaccaggacggcgcgttccgtgccgggctcgtgagacgtcgcggctagatcgtcaacgacgacacggtctacgagttcaccctgcgggtccagccgtccggcggtgccggacgccgctgaactcctctgatgcggtgtccacgccatccacttcagaagccggcctccccttcagccacctattgtctcgacgcccgtcgaagcggcactatctcgccttcagcctgggcagttcgctcgactctgtctttccgcagagtggggaagtccagggccgtcacacgggcgtcacggacggatgaaatgccgccgtctgcgtcagcaaccatctggttgattcgctccacccgcaggagttctccaccgccaggcccgtagaggatcgcgggctccggaagggcctcctgcggcatgaggtcccgcaccgcgcgagttccgcggcggagcacggcaaggtcgcggtcgcccccgacgatcagatccgccagcgtacgtgtcactcgaggaaagtcggtcagcagagccgacacctcgcgcgtggccggtgcgagataggtgtcttcgtcgtctccggcccccggagcgcctgccgagaaggcgagtagcgccgccagcagccggtgcagcgccacgtcctcgaccggcgccggcaagaagaccggtgacacccttaccggcgcctgcgcggcatcagcgagcaacgacgccaccttcgcacgggcgacttcgtcgttgggagactgctgcagttgcccgataccgtcctggaccgcctcgaccccgaagattccgttcagatcgccgggcccgacgccgcgatcgatgtggaacatgctgaccaggatcttgacttcagtacggaaattgttgacctgaagattgtggtcgcctacctggacacctcgggcgccgtgcagggtcacgccagtggggcccgaaagagcgctcgccgggggcgtcggaccatcctgaccccacctgacttcatccatccacgtcgaccgccgaacccgcggtcccccgggcgatcgaggtacctggagctggccgcctgccagttcgcgacatgcccgagccaacggatcttgagcgacctgccccagtgtggcggtcatgaaatgcacccggcctgagttgttctgcccagccttcggtgacaggtcgacagtcaagagaagctctggccgaagggccccgcaggacactttcaaccgcagatcagcaaccgcttccggacccagcagcggcagccgtaccggctctgcaagcgcaccgatctgcaatccgagcagtagtcggcgccagtccggagcagggacgtcggcataccggagcagctcgatggccacctgcaaaccgttggccggctccgacatgaaccactcaaggacaggactcgcctctttttcgctgtcgagttccaccgagcgggtgaccacgagtcgaccatcatcgcgccactgccgcagccaccagacccgcacgccgatccggaggagatcaccgctctcaggcgtcataactctcctcgatcaccacgacctcagccggacgcgacgcccgcagcgcctcgaacaactggtgtgccagcaagagggcatcgcgatggccctgctccgctcggtccacccgctcccgcagcttggccatgtcggcttcgagatccgctacccgtaggtccgcggattccgccgccgcacttacctgcgccagccgtgcccgcacctgccgctcgatggaaatcagcgacgaggacgtcgtccgagggctggtctccccggccttccggatccgggtcgactcagctctgaggtttcctgcccgacgccgtgtccaccacatgccgatcgccaatgcgagcgatgtgatcagggccagtgcgcaacctgatctgagcgcgccgatcgacgggcctccggtgacgggcgtggtcacgatcgtgaccggtccagccaccggggccgagggcgccgtgcccagcttcagcaagccggccaccgcatcggcgtcgtttcggtcgatcttcagcgcggcgcggaaggccgccgccgctcgtgtcctgtcatggcgtcggacagcggcgcgccctgtggcatcggatccggcggcctgcttccgccggccagccacccgctcgatcccgtcaccggcgcagtcgccctcgtccgacttccgcgcttccccatagacgtactccgccgcggtgagtcggccgtccgtgaccaggccggcggcagccgtgcacagcggggtggagagggagcaagcggtcaacggcgttaccacgagcaggaccacgagcgacggaagtggccatgaccaccggcgcagcgtctgccccacccggacctccgccacgatgcgaccggaacctggtcccagtatgtccgtccgcgccggtcacgcaacgaccttcgtggggcccggcgcgtcggcggagaaagtacagtcgccgcatgcgctacgaggaaacgtcgctgatcgatgcgccggtcgaggtggtgtggcggctgaccgtggagatcgacgggtggccggagttcctgccgaccgtgcagcgtgtcgaacgcctcgacgccggtgaggtgcgggtcggcacccgggcccgggtgaagcagcccgggcagctcagtgcgatctggacggtgacccggctggaggcgggccgggagttcacctgggagacccgccgaacggggctgcgcctgaccggccggcacctgctggagccggccggcgcgggcacccggatgacgctggtcctggaggtcgacggcgccgcggcgcgggcggcgacagcggtgctcgggggcatgatgcggacgacgctgcggcgggagtcggccggtttcgcccgccgggcgaccgcgccccgcgactgaacggaaggtatcaggacggccgcaccgcgctcggtacagcgtgggaaaactcatcttgcgggccggccgcaccatcggatccggcgtcacacaatcctccgtaccaccggcacacaacggacatcgtgggaatggcaatgctggacaccgaatgtgaaactgagcgcgagaccgaattgcgcaccctgatggtcaccgcctcgcatgacctgcggagcccgctgaccagcgtcgcggcgcacgtcgacacgatccggacggattacgcgtcggcgctgggcgaggacttcgcccgggatctggccgccatcgagcgcggtctgcaccggatgacccggctgacccaggatctgctcgactacgcccgggccgaatacgccctcgacgcgaccccggtacccctgggcgcggtgctcgccgacgtcgtcgccgaccaccccaccgccgcggtcaccgtggccacgacgctgccggaggtgctggccgacgccggcctgctccggcacgtgttcgacaacctggtgggcaacgccgtcaaatacgcccgggccgggcagtcgccgcggatcgtggtcagcgccaccccgatggcggacggcaccgtgctcatcgaggtcgccgaccacggcatcggcatcccggccgccgagcggtcctgcgtcttcgacgccttccaccgctgcgccaaccgcggcgaccgccccggcaccggcctgggcctggccatctgcaagcggatcgtcgaacgccacggcgggcggatcggcgtcaccaccggcccgggcgggggcagtcgcttctggttcaccctgcccgcggccgcagccgagcgcccggaccgtctaccccaggcgtaggaaggccgggcggggagcgcccacccgcgggccggcgcccagctgggcgctgagccgggcggcgccgccgggaacgaacggtgacaactcgcgggccagggtccggcaggtcgccaccagggcggcgagcacctcgtcgagccggtcgccgtcgagttcccaggggcgttcggcttcgatgagccggttggcgtccgcgacgccggccgcgatcgcgtcggtggcggcccggaagtcgaaggccgccagcgcgcggtcgacggcgtccggcagatcgcgcggcggctgggtcccgcaagcaacgatgccggcacggagccggtggacgagggtcagcgtccggttgaccaggttgcccagaccgttggcgagatcctggtgataacgggtgaccagtcgcggctcggtgaagtcggtgtcgccgaccctcgccacgtcccgcagcagccaccaccgcaccgcgtcgaccccgtagcgggcgaccagatcgtcggggctgacggcggtcccggtgctcttcgagatcttcgccccgtcgacggtcaggtagtcgtgcacgaagatcgcggtcggcagcggccgcccggccgacaacagcaacgccagccagtagacggcgaggaagcggacgatgcccttgccgatcacatgcacccgctccgatgatgcgacccaccattcccggtaggcgctgccgtccagcgcggtgaggtagccggccagcgcgtcccaccacacgtagacgacctgggtgggatcgccgggcaccggaatcccccagccggcggcccgggccgccggccgggagacgctgatgtcggccagccccgcgcgcacgaacgacagcacctcggcgcgccgggtcgccggctcgatccgcacccggccggactccagcgcgtccagcaccgcgccggcataacgggacaggcggaagaaccagttcgtctcgcgaacgacttcgggcgcggcacggtgctccgggcacgagtcctggctcaggaactgctcgcagcccgggcagtagagaccctcgtacgcccgctgatagaagtcaccccgggcggcggactgccgccacaaccgttcgacgccgggtgcgtgccgcgggtcgctgccggtccggatgaagtcgtcgacggacaggtcgaggacctcggcgaggttcgcgaaccgggccgcgttgcccgccacgaaatcggtcaccggcacaccggccgcggcggccgcggacacgttcttcagcgcgttctcgtcggtgccggtcaggaaccgcaccggcgcaccgcgcaggcgccggtgacgggcgagcacgtcggcctgcaccagttcgagagcgtggcccagatggggtgcggcgttgacgtacgggatggcggtggtgacgtagagactcacggggcgtccgatccggggcggaccggcccggccagcccctgaagcgaggggctggtggtggcggaatcagcgcacgccggcaggccccgtggcggggctcgtcatccggcgggtgtgctgtcgcatgtggtccatcatggcgcggcgagccgggtcgtcaaccggataagcggtggggcgaggcggcgggtcactcctcggtgatcgcgctctgccagccctgccggaccccggtcggccggtccaggagggcgaccagctcgctgatcgaggcggccaggtcggcgtcgccggcgtcgatcaggtcgatgagccgccggccgggcacgtcggccgtcgcgcgcggctcggtgggggaagtgtcgtcaccagtcgctgccatgctcgtctcctcatgccgcggtgccggtgacacccaattgactcagattacgtcgaccatcatcattcctttaagtccgctgagtgcacgaaaggcgcccgctgcatgccggtcagtctgcgcgcggtggtggtcgcggtggaggagtacgacgccggtgacccgtgggcgctggacgggccggcgatggacgcggtgcgggtggtgacctggctgcggcgcagcggggtgccggacgaggggatcacgctgctggtgtcggccctgccgcacaaccgggccgcggtcgaggcgctgggcctgccggtgcggcggccgacgcgggcggtcctgtacgacctgttcacccgggagatcgcgggtgacggcgcggcggagctgttcgtccactggggtgggcacggggcgcttgacgacgtacaccatcatcgtcttttctgcgctgacgcgacgaccgcggacaagcggaatgtcgatttcgacgcgctgcgccgttttctggccggggtggacgtccgcgggttgcgacggcaggtgttcctggtcgacgcgtgtcaggtgctggcgtcggagcgcgggtatgtgaaccggttgccggtcgacggctggccggagagtccgcggcggtccgaccgggagcagttctcgctgttcgcggccggggtcggtgaggtcgccgacagtctgaccgtgccgcgggccgggttgttcaccgccgaggtgctcgccgatctgaccggtgcgggactgcccgcgaccgggttggacgtggcggcgctcgccgagcggatcgaccggcggttcaccgagttgcggctggccgggcgggcccgccagaccccggtgtacgtctggttgaagacgccggtccgggagggcaacgtgtacgccacgccgcgcaccgatcgccggatgccgatcgccgcgctgcgcgacatcgtcgcggtcatgctggcggccgaggaggtggcgagcacaccgcggcgggaacgcatgatcatgaccatgccggacgagatccggtcggcggtggcgtactcctcgacgccgcgcgaacacgtgatcgactgggtgcgcacgtgcgagcggttccggaccggacgggcggccctggagggagtcctcgatctgtcgatgagcgatcgggcggcgttccagcggatcgtcgacgccttcgaccggcactggagcccctgagcacgaccccaagacattgaccatcgtacgtttcgtcgcgaaccgtggccgacttccgggactgcgtccggcggtgcgcctcgatagcatcgatggataggggaattgccgaggggttggggcagtcgttgcaccctgagcacaatggagcactggacaaccgcaccggcgtccgccagccgacggtggccgatcgccgccggctgaagaaggccctgctcaagatcgaccggatcaccgacccgggggtgcgcgccagcatcctgcgcgagctgcgcaccgacctggtggatgtcgacccggcccggtccagcaccgccggcatggacatctgggagatcttcagcgagtgcgcccggcgcggcgccgccgagaccttcgccgacgcggtcgcgctcgtcgtcgacgactcccccgagtgggacaccttcgtcggcgtgatgcgggagatctacgcgccgccctcgctgagtgagacggagcggcaggcgatcgcccgggtgatggtggagttgccgcacgacgtgctggccgccgcggtacgccgcgccgagctcaccgacctggtcgacctgggcggccccggcgaggtcgaggccgccgaggtgctggccgtgctgcacgcgtacgagcagggttccggcgccctgatggagcggacctggcgcctgctggagaccgtcgcgcacgcctccgatccggaccgcgaccgggatctgcaccggctgatcacccatgccgcgacccggctcggcatgacggaacgactgctggcgatctgtacgagcgtctcgtccgtatcacctgccgaggccggcgatcccccggacctatcgggcgaaacggacgataatctaccgctgttgtaccaagacgacaccggagccgaggacatgctgagccagatcaccgcgccgccggttgcggttcccgccgtgatgcggggtctgccgccccgcaacgcgtatttctccggccggaccgacctgctccaccggatccgcgacacgctgcagagcaccagcgaggcggccgttctgccgcacgcgctgcaggggctcggcggggtcggcaagacccaggtcgcgctggagtacgcgtaccgcttcagcagtctctacaagctggtgttctggatcccggccgacgacgagcaggcgatccgccggtcgatggtgtcgctcggcaaggcgctcgacatgccggagaccgccgacgtccagtacatgatcgacaatacgctcgacgcgatccgggtgggtgcccagtattcgtcgtggctgctggtgttcgacaacgcgaccgacgtcaagacggtgcgcaagtacatccccagcggcgacaaagggcacgtgctgatcacctcccgcaacgccgagtggcgcggcgtctcgaacttcatcgaggtggacgtcttcacccccgaggagagcctggccttcctccggcagcgctgggagcacctcgaccccgagcaggcccgactgctcaccgagcgcctcgggcacctgccgctggcgctgaaccaggccgccgcgttccacgccgagaccggcatccacctcgcggagtacctggcaaactatgacgatctggtggaaaccgtcaccggcacggtccccgccgactatcctcgccccgtggctgccacctggcagatgaacttcgaccagctgcggaaggagaacccggccgccgcgcagctgctgcagctgtgctgtttcctgagctccgagccgatctccatcccgatgctgcgctccggccgcggcgccgccctgcgcccggaactcaagaaggcgctgcagaacgagctgtccttccgccgcgcggtccaggcgctcggcaagtacgcgctggcccagatcgacccgtcccgcgacttcatgaccgtgcacagcctggtccgggcggtgctgcgcgactccctcggcgacgacgaccgcgccgccgtgcagaaggccgcgcacgaggtgctcgccttcgccaaccccggggacccggacaacggcgagacctggagccggcaccggcagatcaccccgcatgtggtgccgtccggcctggtattctccgacgacccgcacgtgcggcaggtcctggtcgaccagatccggttctacttcagcaccggcgactacgcccagagccggcgcatcgccgagcacgccctggagaactggcgcagccggctcggccccgacgacgtgatgaccctgcgcgtccgcttccacctcggcaacgctctgcggctgctcggcgactaccggcacgcccgcgaggagaccctggaggcgcacagcattctggagcggacgctgggcgccgggcacgaatacaccctggccgtcgccaacagcctcggcgtcgacctgcgcttcctcggcgagtaccagaacgcgctggccagcgacctgaaaacgctggccgaccaccgggcggcgcccgacgtcgacgagttcagcgcgctgcgggccgccaacaacgtggcgatcaactaccggctgctcggccgcttcaccgaggccctggagatcgacgaggccaacgtccggcagcgccggcaggtcgacgtcaccagctcggacccggaaaccctggactcgatcaacgagctcacccgtgacctgatcgcgctgggccgctacaccgaggccaaggagcgcctcaccgagcgtctcccccagttcgagaacaacctcggcgtcaaccaccgcgtcgtcttgaacgcgcggcgccacctggcgatcctgcaccgcaaaaccggtcacctcgccgaggcctacgcccacgcggtcgtcgccgaggaggcgctgcggggtctgctcggcccccggcacgacgccaccctggcggccgcggtcaccctggtcaacaccatgcgggtgcagggcgacgtgatggcggcgcggcgccggggcgaggagacgctgaccgcgtaccaggagacgttcgtcccgcacaatccgcagacgctgctgtgcgcggtggacctggcgatcgtctaccgggcgctgggcatgcgcgccgaggcgtacgagtccgacgccgcgaacctggttcggctgcgcgaccggctcggtgagaaccatccgcacacgctgatctgcgcggccaaccacaccaacaacctggccgccgccggggagaagctggccgccctcgaactgtcccgcgagacgtacgaccggtcgctggccgtgcgggccgccgaccacccgaacacgctggccgtcgccgcgaacctggccgtcgacctggacagcgacggccggcacgacgaggccgccgcgctgcgcggcgccaccatcgagcggatgcgcgaggtgctcggcccggagcacccggagaccatcaacgtcgaacggggccgccggaccgagaccgacatcgaggtcttcacgctctgaccgctttccgtgcgcgatcaggtggtgtcagatcctcgccccctcgaccggtgcgggcgtcatgccggcgacagcctgccccaactgatcttgaggtaccggccgcgaccaggtgtagccctggcctcgctggcagccgagcaggcgcagagcctcggcctgttcgcgggtctcgacgccttcggccacggtgcgcaatccggttgcggcggcgagcttgatgacgacttcgctgagggcgatgccgtcgcccggtccgttgatggggtcgacgaagctcttgtcgatcttcaggatggtggcgggtagctgctgcacgtagctcagcgagctgtagccggtgccgaagtcgtccagggccagttgcacgtcccggcggcggacggcgtgcaggacctccagcacggcctcggtctctccgatcagcgccgtctcggtgatctccagagtcaggcggcgtgcgtccaggccactgtcggccagggcggcgtcgaggtcggcaaggaattccggatggaccagctggcgagcggaaacgttgacgcttatggatgcattcgccatcgccgggacgagttccggccacgccgccgcgtcgtggcaggcgcggcgcagaacccatcggcccagtccgatgatcagcccggtgtcttcggccagggcgatgaagcgatccggtgggaccatgccgtgaccgggccgctgccagcggacgagagcttcggcaccgacgacgcagcccgtgggcaggtcgacgatcggctggtagtgcagccgcaactggtcgccgagaatcgcctcggcaagggcggtttcgtcaccgaggcgttgttccgcgcggtcggccatgccggcgtcgaacacctggatctggttcttgccccgccgcttcgcgtgccgcagagccgcatcggcatcgcggagcagccgtgccgggttgtggctgccgccggcatgcgcggtgctgatcgggcacaggccgatgctggcgcgtagctgcaggcggtgcccggcgatctgtaccggttccgccagccgggtgaggaggcgctgggcgacggcggcgaacatgtcggccggaccgcccgggtcatcggtgaggtgacgggtgaggatcacgaattcgtccgcgctgagccgggccaccaggtcgccggtgcggacggcggtccggagccggtcggcgacctgccgcagcaattcgtcgccgacggcgtacccgagggagtcgttgatggtgcggaaccggtcgagattgagcagcagtaccgcataccgggtgccggccgtggtcgcggtttcgcgctgcgccgcaccgatgcgctccagcaggagccgtctgctggccaggtcggtaagcggatcgtgggaggcctgccaggccaggtgagcacgggtgcgctggcgctccaccacgcggccgacagccatccccacctgttcgagcgcggtgatgatctcggtatccggcgcagggctgctgtgcggcaggtagaaggccagggtgccggtgacctcgccaccggcgagcacggggacggcgacggcagcgccgatcccgcacgcgtgcaccgccgggcccatcggctgcaactcgcgcggggcggtcgccacctgcaccgtcgaggagaacggcaggtcttcgcgggtgggtgccgcgtgctgggcggccaggacgtgcagcgggcaccgccctgccggtcccggctgcggtgcgctggtcgccgggtgcggctcgccaccggcacccaggtgctcgccgacatgccagatggcgcggctgtcgtcggcggtccatgcgtgaccggcacgccagcccagccgggtgcacacctcccgcacgatggcggccgcggcgtcggcgaacacgtcggtgctgttggcggtcacggcagcgtgccgggtcagcgcggtggctacttcggtacggcgctgggcggtgatgtcgcgcaggacggcggtgaaacgcggccggccgtcctgcgtccagctcgacagggacagttcggtgagcagttcgtggccggcggcgtgcacgacgggcacttcgacggtggtaccgaccagtcgcgtcggttggccgctggcggcccgggccacgccggcgttgtgcgccgcgcgggcgtgggcggggatgatgcggtccagcggctggccgagcatgtcggcggccgagtgaccgagcaggttctgcgcgccgaggttccaggccagcacccggccgtgtccgtcgatggtgatgatgccgtcgaccgccgagtgcagttccagcagccgggcttcggcggcacggcgctcggtcagcgattcgacactgttgagcagctgccatgggccgtcgcgatccggctggatcagcgagctggacaccagcgccgagatcagcgagccgtcacggtgccggtagcgcttctcccggagcgccgcgcggcgcagaccggccaccagctcggtgatcgcctgcacatcggtgtcgatgtcggtgtcgtcggtgaattcgcggaagctgcgtccgacgaggtcgtcgacggagtagccgagcaggtcggcgaaggcgcggttgacccgcaggaacctgccgccgtcgtcgacgagggtcataccggtggtcaggtggtcgaaggcggtctggaactggctgttcgcggcttgctgtgcctgttgtacggcgaccagctcgatgccggcccgttgcgcctgcagcagccgtcgggtgaccatcgccagcgactccaacgctgccatctgcgacgccgacggtgtgcgcggctgcgtgtccagcacacacaccgtgcccaccgggacgtgatcggcggacaggatcggcaccccggcataggcacggatatgcggttttccggtcacccacgggtggtcggcgaaccgaacatcggcatgcgtgtcggggaccagcagcgcggccgatctctgcaccacctcggcgcagaacgacgaaccgcggtcgacgctgacgccgtcgaaacccaccgaaccgacgaaccgctggtcacgctcgcccatcaggctgaccgcggccatcggcatctgacagagttgagccgccagcaccgcgaccgcttgaagatccgcatcgacaccatcggcctcgtgacggaccggccaccgcttctgttcgtcgagcaccgtatctcccgctcatcatcaggcccgtgcgcgccggatcaaccagccacatcggccgctgtcacgttctgctgagagcagctccgcaatcgcaaccctgccgacagcggaggcggccggacgagcgtagagtcgaccgatgcggctggcgggaatcatcgacacaccggagaaggcgggtgtgcacgaccatgtcggctgggtcttcgacaagccggccgactttcaggtacgtgccggccggttcctgtccgccggactcgcccgccggcagcgggtcgtctacgtcgcgggaaccgacggcgacggcccggccgagatgcccggctgggacgaggccctcgccagtggtcaggccgagctgacctcggtgaggaccgtgtacagcgccggcgaaccggtcgatccggagcggcaggtggccgcattcgtcggagccgccgaacgagccctgcaggacgggtggagcgggctccgggtcgcggccgacgtgacgtcactggtgctgaccgagcaacagcgggcggcgtggacccgttacgagctgctcatcgacgcgcacatggcccaccacccgatgaccggcatgtgcggcttccaccgcaccgcgctggaaccctccggcctggccgcggcgacctgcatccatcccgcgctgagcgaggacaccagcgcattccgcctctacgccggcggccaccccgacgcgcacatcgtggtggccggtgagatcgatcccgagaaccgacttctgttcgccacgacgctgcggcacgcccggccggagccgctcgacggtcgcctgctggtggacgcctcgccgctgactttcgtggattaccgcggcctcgtcgagctcgcgaactatgtcgccgaccggggtgccaccgccgtactgtatgccgacgaggcctcgatcgccgccatgatcactcgggtggtcccgctgaaagggttgcaagtgctggtgcgcccatgagaaccggtgccgccgccggccaccgcggctacttccacgaaactgctttctacgacagcgacgaagcgttcctgtcgacgatcgtgcccttcttcaccgcaggactcgaagcaggcgaacccgtcgtcgccgcattcgccgccaccaaccagaacctgattcacgacgtgttcggcgatgacagcggcatccgatacctcggcggtgaggcccagtaccttcgaccggccagcgccatccgtacctaccgcgagctgttcggccgatacgccgcagccggagtgcagcagatccgcgtcgccggcgacgtgccccacccgggcgtgggtgtcccttgggactcgtggcgacgctacgaggctgctgtcaaccacgcctacgacgagttcccggtctggggcgtctgcccgtacgacacccgtacggcgcctgaccacgtcatcgccgaggtccgccgcacccacccgcacatcgcccacgccggtggccacgccgccaaccccgcgttcgaagacccggtgggacttcttctcgcccaccggagcgaccactggtgcgacccgttggagcagcaaccgccgcacctggagctgctcgatccggggagcgggccggcccgcggctcggtggccgcgctcgccggcgacctgctcaccgccgaggatcacgccggcctgctggttgccgtgagcgaagctgtcaccaacgccgaaaaacacggccgggcccctgtcgtgcttcgggcctgggcgggaccacgccgggtcgtcgtcaccgtcaccgacagcggcgacgggccgactgaccccttcgcgggtctgctggccaagcgtgatgcgccgagcggcggcctcgggctctggatcagccaccaggtgtgcggctacgtcggattgcagtcggcacccggtgccttcaccatccggctcctggccggggatctgcccgcatagcgcgccgcgccaccatccgatgcctcatcggcggcgaagacgacgccggctgagcaggatcagggccaccccacccgccacgaggatccatcccccgatcagcagcggcatgtagtcgcctccggtgaccggcgagtgcggccggggcagcggggagggtgcggcgggcgtgccgggttcaccgggtgaccgggtcggcgccgcggtgtgcgtgggcgtggccgggtgcgtcggcgtggccgtaggcgtcggcgagtggctgggtgaggcgtgtcctgaggggctgttcgacggggagatcgacggggacggcgatgccgacggagccgccggagtgatcgagccgggcgcttcggcctgcacaccggacggtttggtcggggtgctcgcgtcggcccggaccaggaagctcgtccccccggcgatgtcctgctcggacaggtggtagggcgcggaggtgcaggtcatcttctcgcccggggccagggtggtgctggggcaggtcacggtgaccggcaggccggtgagcaccacgccggtgagggtcacgttgccgttgttggcgacctcgacggtcgaggtgatgtcgtcggtggtgcggggtttgccgtcgccgtccgcgtcgttccaatgcagctgctggctggcggtgaccgacggtgccgcgggttcgaccggcgtgttcgccgcgcccggcggtgactgcacggtcgtcgtggcggggtcggcgccgctggcgaccgccgtgttggtgatgatccggccggtgtcgatgtcctgctgggtgacctggtagacggcgtcggcgacgcaggacatcgactggccgaccgccagcgtggtggacgggcaggtggccttgccgaccaggccgtcgtggacgctgacatgggtcatcgtgacgttgccggtgttgaagaccttgtagtggtagcggatgttgtcgccggccgcgggggcggcggagagcacgacgtccgccgcggagatctcgccggccctcgtcttcggttcgatgaccgcgctcaccccgaccagcaactgcccctgcgccggggcgaccggcaccgatcccgactgctggtcgtagacggtgtcggacggcgcccccggccggcggccacggacctcggcctgatcggccagcgcgacaccggcgtcgacgtcggcctgggtcacctgatacggcgccagggcggcgcaggtccgcaccgcgccgacggcgagcgggccggtcgggcacgtgatccggccggcccgggagtcggtgaggctgatgccggtgaccgcgacgtcaccgtcgttggtcaccgtgtagcggtaggtgaccgtgtccccggcgaccgcgccgagctggtgcgcggccggtgccacggtggcgctgacggcgagggccagcgagtcggcggcggcggccataagctcggtggtggtgaccgggccgaaggacaggaccggcacggtaccggtggcccggccggtggcggtgacgctggaggtgatcggcgtgccggcctccacgtccggttgggtgaccgggtaggtggcgccgccggtgcagttggtggtggcgcccggggccagggtggtcgcggcgcaggcggccgagccgctgcgggtgtcggtgaccgcgatgccggtcatcgtcacgttgccgatgttgcggaccgtgtaccggtaggcgatggtgtcgccgagcatgagctggtcgtggtggccggccggggtgaccgcggtgctggcggtgatgcccagcgcggggccggaggcgaccaccgggaaggaggccgacggcgaggtgagggtggtcgcggaggccgcgccggggctgcggccggcgaccgtgacggtggtggcgaccggtgcgttcgtgtcgacgtcggcggtggtgacggtgtacggggtggtgctcaggcaggtcatcgacgcgttcggcgccaggctggtggccgggcaggtcgcggccccggaccgcgggtcggtgacggacaggtcgctgatcgtctggttgccgctgttggtgagcacggtgcggaacgtgacggtgtcgccggtgtcggcggcggtcacgtggccggccgggctgatcacggcggtgacggcggcggtgagcgcggtggtggccggggccacgttgatggtggcgatggccgggccgaaggagtacggtgccgggaatccgacctgccggccgtggatgtgggcgtcggagacgatcggcagcccggcgtcgaggtcggactgggtgaccgggcgggtggcggtggagcagaccacggtggcggtcaccgccagtggcgcgccggggcaggtgaccgtgccgaacagggtgtcggtgacggccagggtgtccatcgtgacgttgccggtgttggtgacggtgtacgcgtacgtgatgctgtcgccggccgcggcggcgctctggtgggccgcattggagacggtggcggtgctggcgatggtcagcgtcggcgcggcggcggccaccggtgcggtgacggccggcgccgcgaaggtcaggtcggtgggagtgccgccgcgccgggcgatggcgccgccggtgtccgagatcggcgctccggtgtcgacgtcggtctgggtgatggtgtacgtgccaccggtgcacgtggtgccggcgccgacggagagcgtcgtgaccaggcaggacgccgccccaccggtggagccgctgacgcgcagcgtgtccatcgtgacgttgccgatgttgcggaccgcgtagctgaacgtcaccgtggaaccggcattgacgccgccggcgttcccggtcgtggtgatctgcagcagcgggttcgccggcgcgatcggcacgctcgccgggaacggcccgtacggctgtggtgcgagatcgctcgggccctggccctgcacggtggccgtggacgccaccgatccaccggtgtcgacgtcggtctgggtgacggtgtacggcgtgacactggtgcaggtcatcgaggcggccacggcgagcgtggtgccggggcaggtgaccgcgccgatcagcgagtcggtgacgccgaccgcggtcatcggcacgttgccgttgttggtgaccaggtagctgtagtcgatggtgttgccggtcgcggcggcgaaccggttggcgggcggggtcaccgcgggcgtggtcgtgacggtcagcgacgcggccgcctgagccagcgcgaccgtgtccgagccggtcgcgtaggtgccggccccggccgcggtgggcgcccgggcggtcagggtggcgctgtcggcgatcggggtgccggtgttgatgtcgttctggtcgacggtgtacgacccggtgctggtgcaggtcatcgacgccccgacggccagggtcgtcgcggggcagctgccggcgccgccccgggtgtcggcgatcgcgatggtgtccatcgtgacgttgccggtgttgctcaggtcgtaccggtaggcgatggtgtcgttgacctgcgcctgattctgccggctcggtggggtgaccagggcggtcaccgccatgctcagcgacgggacggacggtgcgacgttgatcgtggcggtgaacggcccgaacgccggggtgccgccgccgggggcgccggcggcgacggtggtgctgacggtgatcggcaggccggcgtcgatccgggcctgggtcaccgtgtacggcgcggcgccggtgcaggtcatcgaggcgccgacgagcagcgtcgagccggggcaggtgaccgtgccggcgagcgggtcggtcagcgcgatgccggtcatcgtcacgttgccgtcgttgacgacggtgtaggtgaaggcgatggtgtcgccgacccggacggcgctctggtgggcggccgggttgaccgcggtggcgaccgtgaccgccagcgacggcgcggcggccgcgacggtcaccgaggtgctggccggcccgaaggtggtgccggacaccgcgcccggggcccgcccggtgaccgaggcggtggccacgatcggattgccggcgtcgacgtcggcctgcgtgaccgtgtaggtgccgccgatcgtgcaggtgaccgaggcgcccgcggtgagcggagtggccgggcaggtggcggcgcccagccgggtgtcggtgaccgcgatggcggacatggtgacgttgccgttgttgctgaccgtgtagctgtagccgatggtgtcgcccgcccgggcggcgttctgccgggccagcgggctgaccgtggcgttgaccgcgacggcgagcatcggggcggccacggcgaccggcaccgcggtgctgaacggcccgtaggccgacgcggcggcgccgggcgcgcgaccggagacggtggcgctgtcgctgatcggcgcgccggcgtcgacatcggcctgggtcaccgcgtacgagccggtgctggtgcacgtcacggtggcgttgacggccagcgggccgccgggacaggtgccgatgccggtgcgggtgtcggtcacgccgatgccggtcatggtcacgttgccggtgttggtcacggcgtacgagtagctgatggtgtcgttcttcgccgcggcgctctgccgggccggcggggtcacggccgcggtcaccaccgcggacagcgcgggtgcggccgggacgaccgccacgctggtggagaacggcccgaaggtccgatcgctcgccgcgttggcgagccggccggtcagggtcgcggcgtcggccaccggtccgccggcgtcgatgtccgcctgggtgaccgtgtacggcgtgccaccggtgcaggtcatcgaggcgttcacggcgagggtggcgctcgggcaggtgaccgccccgcccagggtgtcggtcgcggccacccgggtcagcgccgcgttgccgtcgttggtgagcagataggtgtaggtgaccgtgtcgccgacccgggccgcgccggtgtgcccggacgggctgaccgccgcggtgaccgtggcccgcatcgaggcggtgccggtggccagggtgacggtcgccgcggccggcccgaaggtcgccgccgccgccccgcccggcggcgtggcggtcaccgtcgcgttgttgtagaccggctgctgggcgtcgaagtcggcctgggtgatcacgtacggggtggtgctggtgcagaccatcgacgcgccggcggccagcgacgtgccggggcaggtggccgtgccggtgagcgcgtccgcggcgctgatctggctcatcgtcacgttgccgtcgttgaccacggtgaaccggtaggtcaccgtgtcgccggcgagcgccgcgttctgccggccggccggcgcgacggtggccgccgcggtgatccgcagcgacgagttggctgggtcgatcaccacggtggcctgggcggtgttgttgccggcggccgggtcggtgctgtcggccgacagcagccggacggtgttggcggggctgccggcgaccagggccgtaccggtgagcgtgagcgtcagcgtcgcaccggccgccaccaccggcaccgaccaccggccggtgcccgggtcgtacgtgccggcggcggcggacccggcgctgatcagcaggccggtctgcggctggacctggatcaccacggtggtggcgtcggacgggccggtgttacgcgcggtcacggtgaactggaccgggtcgctggccgtcacgtgcggggtgccggtggtctcggacatgccgaggtcggcgatgcgggcgaccgggatcgtggtggtcacgctgtcgttggacgagtccgggtcgggtgaggtcgccgacaccgtcgcggtccgggcgaagttggcgccgctgaacccggccggcagcaggctgtcgaaggtgatggtccaggtggcgccggtcgccatctgcggctgggagcagacgaacaggccgccgtccggggtgatgccgttcaggtcagtggtgccctggaaggtgcaggcgcccgccgccgtggacgcggccgggaccggctgcccggccgggatcggctgctgcaccaggacaccctcggcgcgggtctggccctggttggtcaccgtcaccacgttgcggacatgctcgccggcgaccgcgttcgatccagaccggtccggatcggtgatcgtctgggccacactcaggtcgctgcgcagcagcacggtgaagttggtggtgagcttgtcgttggccgggttgttgtcggtggtcgtggagatgaccgtgacggtcgccgtgccggggccggcctgcgcgtcgggcgcgagcacgacggtgccggacagcgggatcgtggcgccgttgggcaggtgcgggatggtgcaggcgttcggcgtgcagtaggcggcgaacggcccggtggtcggccggatgatcgaaacgccgggcggcagcaccgggacgaacgtgacgttgtccgccatcgacggcccgtagttgtgcaccatcagggtgtaggtcgtcgtgtccccggcgtacgcggtggtggcgcccaggctgagcgtgatgccgatgtcggcctgctgggccccggcgccggtcacggtgacgatgttgttgctgatgtccgggtcgggcgtgctcgagttgagcgagacggcgttgttcaccgtcgtgccgctcagcgtcatcgtgatggtgaccgtgacactggcgccggacgccaggctggccagcgtgcactcgatggtgccggtcgacgtcgacgcgcaggagccgccgggcaccaccgccgaggcgttggtcgagccgctcgggatcgggtcggacagcacgatgctccgggccgtcgacgggccctggttggtgatcaccgccgagtaggtgatggtggatccggcgatcggcaccgccggcgcgtaggtcagggtcacccccaggttggcgctcgccgtcgacaacttgctgaccgatgcggagttgtccgcctgattggtttcgtacgtcgcactggtcaccgcggcggccagcgtgtacgtggtggccggggtctcccccggcggcacgttgccggtgatcgtcatcgtccgggtggcgcccgaggccacgctcacgtagtcacactcggcccgggtgccgctgaccgtgcaggtgccgccgggcgacgccgcggtcactccggtcagtccggcgggcaccgtgccgatcagctgcaccgaggtcgcggcgctcggcccggcgttgctcgccgtcacggtgtaggcgaccgcctgcccggcgaccaccgccgcgctggccagggccgcggtgaccgacaggtcggcggccgggttgacggcgatgctcgcggtgtccgacgtcgaggtggtggcgctgccggacagcgtttcggtgtacgccgcggtcgtgtcgttgtcgagcgtcgtcccggccagcgccgaggtcaccaggacctggtacgagaccgtctggctgtcccccggcgcgagcgtgccgccggtcgagctgttcgcgccggacccgacccggacgttgaccgtccgcgaaccggcgttgtactcaccgacgtcgtcaccggacgcgtccgtcggtttgacggtcgtcgacccgctgatcgatctcagcgagcccggcacgtacgtcgtaccgacgggcagtacgtcgctgaccgacgccagccgggccgggttgccgccgttgttgcgggtcgtcaccgtgtaggtgagggtgtcccccacgttcgcgctggtcgagccgttcgcgttggcgaccgtggtggtcgtgcccaggcaggccgccgagccgaacgagatggcgtcgaggaagttgccgacactcgggctcgtgctggccgaggacaccgaccggaaggcgaaccgggtggaggtctgtccggccggaaccgtgtagacccccgagtaggtgccccaggcggtgttcgggtcggagatgttcgagccctgctgcacgagcgtgccggacggcgccccgatgacgaccgccatggtgtcggtgccggtccggccgcggtggctcagctgccagcgcagcgtttgtcccggagtggtcggcaggtcctggtagagcgtcgacaccatgttggcgttcagctcggcgtgctgactgccggacgccgacacgaccccgccgtacccccgccacagctcaatctgccggtccgaggcggtcgtcagccagcccgggatcagtgactgcgacatgatcgagactgagccgctggagatgaccggctgctcgaagtcaccgttggtcaggaccaccgcggccgggcagaccgtctgcgcggcgagcgccggtcgcacggtgggcgggagtaccacggacactgcggtggcggtcacgacggcggcgaggatcgcagcgagccggccgagtggatgacgcacgggtcggtgcccctcttcgatggggatcgcgaggcgagccacggtttcggcccgccatccccgcacagtaggggaatacgcggacaaaaaggtctgattggaaacggtcagaccttgccaaagggctgacgcgggagcgtgccgccgccgctgcccaccgccggtcatgccatggtgcctaggccagccgcaggcgtaccaagtcgttttttatagggattttttgcccgtgaagcgaagagaacgggcggccatccggagatggccgcccgcagaaatcaggtcagatcggtgaggatgtcggcaacgctgccgaccggccgggcccggctgtcggtgcgcagcacgtcgaggccgccgccggagtggacggaggtgaccggcccgggaacgatgaggccgtgacggcccagatgcagtgcgcgccggacggcgtgcagggctgcgctccgtggtggggcttcgacgagcacggtcgcagtgctcaggtcggccagtaggcgtttgacgtagagcacgcggtcgcggacgggctcggcgcccggcgggtacgggctcaggagcagcccggtgtcgccgacgagttcgagcagctgccggttgccggtggggtgaaggtggtcgaggccgccgggcaggacggcgatgggcggacggctggtgcgcagggccccgagcatggcgctggtggcgatgccgtatccgccgtcggtgacgatggtccagtcgcgttcggcgaggccgccggccaggtcggtggcgacgtggctgccgtaggcggtgcaggcgcgggacccgacgatggtgatggcttcggcggcgtacggcggttctccggtgccgtggctccataggcacagcgggccgtcggggtcgaatccgcagggccaggtggaatcactgggcgtgatgatgtggctgtcctgggcggtgtgccgggcctgggcccagagctggtggtcgggctggccgcgcagttcacggcgcagcatggcagggatcagcggctcgtcgaggagggcggcgacgacctcgtcggggccgtcggcgatgacccggcgggtcagcggcgggttgccgggttcgaagagccagccgagcgtgatgtacgcggtgcggatctcgtcgtacgggttcatcgaggggtgtcctttcggtcagtgccgcgcgctcagcggggtgagcgggtcggtgtccgggatggggccgaacaggtcggtgagcagggtgcgggcggcgggtgcgcggcggcgccggccggggagtttcttgccgtacttccactgccgttcccagctgccgtcgctgctgagggtcagggcggtgggcacgagcaggtggcagcgcagcagcgtggcggcgacggccaggtcataggggaagcgtttggtgtcgcagtagccggcgatccactgcggccggtccccgccgttctgcggccggcgcagggtgaaggtgtcggcggcgtgaccggcgacgcggtcgccgttgaaggtgaggtcgccggtcgcgtcgaggatcggccggttgtcaccgagaggcccggccaggtcgatgccggcgcggcggacggcatcgacgatccgcacggtgtcgttgaccagctgcggccaggcggcctggtaggcgggatcgttgaggagcagggaccagtagtggaggtagcccatgagaggtgtcccttcgcgaagaggggagatcccgggctggcgtgcccgggatctcctggtgatcaggacgggcaggccgtgggtcagtgctggggtttgtgcagaacttcgcgcagcgcctgtgggctgatgccggcctggagggcccgttcgagcaggtgggcgaagtcgtcgtcggggtcggctgcgcgggcgcgcccggcggcgatggcggcggtggtgccgtcgccgccctgcagggcggccagggcgaggaaggtggccggggtgcaggcgagcgtgccggtgccggcccgacgggtcagatcgcgccaggcgtgcacgtcctcgtcgctgccgtgcaccagatggacggcgtagttgcgcagctcagcgaaggcgagcagcaccagcagttgagcggcatcgtcgtcgctgagcgggccggcgagcgcctgttgcgtgagctggtcgatcagccgcatcgcccgtcggtggtcgatcggcaggaccgtgctctgcaggatgcgggcgacggcggcgcgcatccgctgtcgtggttctccggtgatcgggtcgaggcgggcttcgagggtttcccggtccggagcgagttcgacaccggcgaaggtggcttcggcggcgatgatcgtggtctgcgggtcgaacgcgacgccgttgcgctcgcagtccgggtcgccgcagccgacatgccagagccggccgtcgtcgacgcgcatcgcgtcgagcaccgtcacgccgatgctggtgaacaggtcgatggcctgttgcagcgggtcgcgcatcgactggtgggtgccgtaaccgacgaggacgacctgggtgaagccgttgttgtacaccacggtggccaggcggccggcggccgcccgggggtcgggcatgccgtccagtgcttgtgcgccggcgaaggcgaccgtgccgtcggcgacggcgagcacggtgaggcagttgaccggctgatagccgagcaggtaggcgacgatcgtcgcggcatcggccgagctggtgatccggatttccggtcgttgcatggtcggggttctccttggctgaggccagggaacctgcgcaccacggagcccggacgtccgccggggatggtgctcgggtcccccggcgagggatcaggtcagtactggtggtggtcggtgttgtccgggcagcggtcggtgacgattccgccgccctggtgtttggcggcgtacatcagccggtcggcgtgagtcagggcgcgccggtgatccccgccgggaacccggcagatgccggccgagaaccggaccgggacggggtgaccggacagtacgaccggggtggccaacacggccgtcagctgccgccgcacggtgtcgaccggtcggcggctgatcaggacgaactcgtcgccgccgagccgagcgaccacatcgcctcgctcggcggcctgctgcagccggacggcgagggcggccagcagggcgtcaccaccggcgtgaccaaaccggcggttgaccccgtgcaggtcatcgccgtcgatcagcgccacggtcacctcgccgcgggcccggtcgaggtgccgttcggcgacccgccgcaccgagatcccagtgaccgggtcccgcagggcctgcgccacctcgctgcacagccggatcagcagcacaccgagcacggccgcgtgcagcggcatgatcaccggcagcagcggcccgctgaggatcaacagcaggtcggccagcacgaccagacagacggtccgcacggcgttcatccgcgctcccggggctccgtgaccgcggcgaccaggacgtcccggcggcccagcaggttcaggcatcggttggcctgctccaggtaggtcagccgggcatcgagccggtcgtcgggttgggccagcagtaggccgtccgggtcgagcagtgcccggccgggcaccgcggacagccagcccaggtgggtgtaggtttcggcgcccagttgcagcgcctccagatggctggtcggcagatcgaacggccggtacggcatcgcgttgtagacgcgcatcgccgcgatccggggctgggacagatagtcggtcctggcccgggcgaactcgtaccggtgcggagcggcccggtgccggtccaggaacatccagtacggtttcgcggtcggtgtgccggcgaccgtctgccgccaggcctgccaacggaaccagtgcagtcggtgcacgccttcacgcatcgcgtcgagctggagccgggcgaccggtcctccggcggcggcgccgcgcagcgggagcagcagcgagccgcgccgccagcgggtgacggccgggaagtgccggagcagaccggcggcggtcagcccggcgcgggccaggcggagttctgcctgtacggcgtagtcggagggtggggtgtctgccggtaggcagacgagggtggtccagggcatggtgatcctccaaggatcagagcagggagatgggtgcgcacgacggcgcgatccggcactgccggatggggtgcggttcgcggcgccgacgtgcggtgcgagccgaccgacctgctgagcaggtggtgggcggtggctaccgcggtcgtgggcggcgaagcccgcgaagtggtgctgaagggatcacagaagtgatgccgccgaccgtaaccgccctacccaacagcccgggtcacgccggtcgctgatgcggtcgcggcttacgccgcagcgcggtgtcgggttcgtcggccagctgcgcggcccgcgcccggatgtcgtcgttgcacgggtcgaccgtgatcgcggcccgcagcagctgcagcgcttcggccggtgccgccgcctcggccaggtcgacgtagccggtcaggatccgccggcgcagggtttcgcgggccgggaccagccacggccagtcgcagccggccgccagctcccccgcatacgcgtcgatgagcgcccgctgcgcctgccgccgctcggccgcggtgaccgcacgatccacccggcccgccgcatcccgcacgacgtgcaggtcgacctcgaccgcggcggtcagtcggtatcggctgcgctcgtgccggatcagttcgacctccgtaccgtggcgaaggtctttgcgaagttcgctgatcgtgatgtacagccggttggtaatgctcgccgggcgcagcccgggccagatcgcggcgatcagctcgtgaccggtcgcaccgtccgggtgcagcccgagataggcgagaacctgcaggccggcggtgcgccgcaccggcaccggacgcccgccgacactcagcgcgcagccacccaacagccgcagtgcggcgaccgcctgctgcggtgcgccggctgtcggcggttgctgcgggtgggctgcggcgagcaggtcgagtaggtcggtggcggcgcgggcgttgagcacgcacagccgccgcgttccggtaaccgtcccgtcgaggtcgacctcccaccgcgtcgccgccgcaccccggccggcgctcacccaggtgccggtcgaggtgagcgggtgcagggtcagtgtcacctcgtcgctgtcagtcgtgtccgggtcgtcgacgacgcgcagcccggccgggaccggccccgcccggtacgggtcgtccagtagttccccgaggtccgcccaggtgatgctcaccttgcgcccgctgagcagcagactgatcagcagcccgcgcagcgcgtcgcgggccccaggcccggtcagggcgatcccaccggctggcagccgatcaaccagcgcagcggccgccgtggactcgccggacagtgcggccaacgcgttcacggtggccggcagcggccgcagctcctcgctgccggacgcgcccggccggtagtcgcggcgccgccgcagccagagggccgccgcggtgctcgccactgcctgaccgaccgcgatcgggacccacccggccccgtccggcagctccacaccgcgggcaacggtcgtgtctccaacggtggtcgcggccgctgccggggtggccggtgcggtcaccgcgacgatcgcgggcccgcccaggaccaccgcaccggccatcgacccggcggtcagctgcgacggagtcggcatccgcaggtgcatgcgggcccgccggataccgcggcgcagcaccgcggtgctcaccagcagccacaccagcagggccggaatggcgccgacggccagcacgaaccgggtccccggcgggccgtcggtggtcaggtcagccaggctcggcagctgctgcggatggtctacgaaccacagtgcgaccagcgcgggtggtccggcgaccaccgcgagcgcgaccagcaggacgccgaggccacgtacggcgcggatcaccgcagcagcgcccagagccgctgcgcccaccaaccggtgacggccagcgagaccgcgaccccgaggacgttgttgagccggaagtcggcgatgaagaacccgaacacgccgagcgtcaccgcggcgatcgtgcgcagcaccgcgatctgcagcagcaacatggcgatgcccacgccgatcagcgcgactcccacccgggtaccgatcaggaaccacaggtgcagccacggcaggtgtcggctggtgaccgtgtaggagaacagcaggtctccaccgcccatcagcagcaccggcagcatcgggaagtccccggccggcgggcccggccgtttccggttgcgcagggcgatggcgaccacgatcagcccgatcggcaggatcggcagcagcgcccagcgcagcggcagggtgaacggcaggatgaagtagaggccgccggccaccgcgtacagcgcggcgaccgcggcggcgatcgccaccgcggtgatctgccccgccgcccgctgcccgggcgcgtcccaccggcccttgagccgctgatcccggctcagcgccaggccgatccacgggctggcggccacacacacgaccagggtcagcacgcaggcgatggcgagctcaccccagttcgcccacacccaccacggcggggtccgcagcacccgagagccgctgaaatcggccgagaacacgaaatgcgcaaacaggatcaacgacaggattcctggtacgagcagtcccagcgtgctgcgcagcgtcggcggcggcacctcaccggccgtctcctcgaacgcggcgccggtcgcttcggccgcgccgagcaccgccgtcgcacccggcatcggcaccacctgcacgggcaccccgagccgttgctcgaccgccgggcgcagggcgggcatggccgcgacggcgccgacggcgtagacggctgccaggtcggccgggctgatctcggccgcgccgacggcggccgcggccaggtccgcggcccgactgaggacgggctgtgcggccgcctccacggtggcggcgttcacgatgaccgccgggtcgggcgggggcagcggcacggtcacggccggctggaacgaaacggcctccttgccggtacgcatactggccagcaccgcccacgatggcgtcccgttggtggcgccggtggccggcacgagcagcgtgtcggccaacaccttgtcgacggcctgtccgccggcatcggcgtcgtacagcgtggacagcacctcgaagccgcccggcccgcgccgcagcacgctggcctccatcgtcgccccgacgtcacagaccagcacaaacgtgccaacaggcagctggacgccggccaacagttggtggttggcgaccgcgatcggcgtttcgaccagcgtcggcattcccaggccggcccgccgggcggcctgccgcagccaggtccgccgccgcggtccccacccggccggcacacacatccgcacgtccaccgggacggttccgcacagtcgggcagcctcgtccgcgaccagtcgcagcgtcgccgccaccagatctgccacctcgatgtcgtggccgtgccgttgcacggtgccggtcccctcggccagcggcgcaccgacgaatccgtccgggtcggtgacggcgaggcgccacgcggtgttgcccgtgctgatctgcccgctcgcatcgacgtgcgcgacgctgctcggctccggacccccgtcgatcgtcacgggctgccaaggctgatccggaccggcgatcaccgcacgagtgcaggcggtgccgtaatcgatcgccagacgcggcgctccgaactgcatggatcacatacaaacagatcaccgccaatgcgtcagcaccaattcgcgtctgatcaggcttcgtaagggcggcgaaaggttgtgtatggaccttgtcaggtgcgcacagcgccgaacgcgcccggcacgcacctagcgtcgctgacaacgcttcacctcgacgacgccggaggtcttcgtgcgcatcggcctgattctgtccgtcgtgctggccggattcccggtcgggctcgtcgccctggccggctcacccctgcccagccggctgccgaccggcgtggatctgcaagcgtgggccgccaacccgttcgccgcaccattcctacccggactgctggccgccatcgcctggttcagctgggcattcgctgcggtgctgtcactcaaaatcgcggcacggtcagcgcaccggctcagccggcttgcccagtacctgcccgggccgctgcagggcctggccgccaccctgctcggggccgccgccgtcacggcgacctacgcaccggcggcggccgctcccccggcgaccgcgacggccaccgggccgaccctgctcaccggaaccatcaccgaccgggcgcccaccgccggtcacgcggacccgacgtgcaccgtgcaccgcggcgacacgctctccaaaatcgccaaacagcggctgggtgacccggaccgctggccgaccatcttcaaactcaaccgcggcaaacgcttcccgaccgtcggcggccgtctgaccaatccggacgtcatcttccccggctggaaactgaaaatgccggccaatgccaccccgccggcctccgacacctgcaccggtcccgcggcggcaccgacacacagaccatccccgaaacccagccggccggctgactccggcaacaccgtcaccacaccggtaccggcaactgcagcgccacaagcggcgccgcagacgaacaaccagaccgggcccgcggtcacgctcggcatcgccggtctcacgatcgcggccggttgcgcgtacgccgcaggcctactgtggcggcgcaaacgtcgcgccgcgcatccaggcgacccgacccgaccggccagcgtcaccctgctgccgaccaccacgcccgccggccggcccccgaccgccgcggcgtccggcgcagctaccccagcggccagccaccagccgatcaccgtgcggccgccggacaacccggccaccgccctgatcgggccgggcgcccacgacgcggcccgcgccgccctggtcgccgtcatcaccggcagcatcgccgacaccaccgcactgaccaccgcggccacccgcgacgccctgctgcccgacacaccgcttcggggcggcgtcaccgtcgtcgaggacttcgcggccgcgctcgccgccctggacgaggagatcatccgccgtagccggctcgccgatgatctcgatgacggcgccccgccgaaacccaccatgctggtactcaccgacgtcccggacaacgcctggcacggccggctcgccaccgcggcacgtgaaggagaacggctcggcatcgacatcaccctgctcggcgagtggccgtccggcaccaccctgaccgtcaccgcggacggcgccaccgaagccggtgaactcgccgtcctcaacgccggtgccgccgccacgctgctgaccgcagccgagaagaccacccccaaaccggccaccgttgttccgatgaccgtcgaaccggccaccgtggaacccgtcgccgcgccagcggagcatccgaccaccggccgggtggccatccgcatcctgggccgaccggccatcctcggacccgacggcaacccggtccgcggcctgcgctccaaaagcctggaactctgcgtctacctggtcctcaaccgcgacggcgccgccatcgacgacatcatggaagggatctggccggacgtcaccgtcgcccgtgccaccgaccgcctctccacctgcgtcgccaacctgcgcaacatcatccgctccggcgtccgcggcggcctcccgccccatgacggcaaccgcctggagccggtcatcaacaccggcggccgctaccacctcaaccccgacctggtcgacgtcgactggtggcagatcctggacgcccacacggccgcggccaccgcaaccgacgacagcacccggctggatcacctgcgggaagcggtcacggtggccggcgggcgtgccccggcggcggacaccgcctacgaatggatcgacaccgaccgggagcaggcccggcggctgctgatccgactgcacctgcagaccgcacgtctggtcgccgacgacaacccgcaggccgcgcgcaccctctacgaaaccgcctgcgactacgacccgatgtccgaagaactcgcccgccacgccatgcaggccgcggcccggctacatgacgccgacggcatccggcatcgccgagagcagctccaccaggcgctcgccgaagccgggatcgacgccgacaccgcaaccgaccgccacgccgccgagctgctgaacggcctcaccttctcccaccagcggtagacgcggcaggaaagctgcccttgacggctcgctgcgagcagccgcgtgtgtcggatcaccctatgtgcgttcgaccagttctttgcctctagctagctagcgccgccgcttgcgactgaacaacgctctggccacgcccccttgtactcctgccgggcctgaggcactcgtaccgtgaccagtaaccacgccgttggggtgatactgcgcctgctcgtcgacgccggtctcgtaggtgatcgactcgacgatcaggagcgtaggatcttccatccctcatgcacgcttcgtcaaagcctgtgttgtgcccacttggtgcacgccgagccgtacttcgcttagcggtcaccatcggggtcgaacaccaggtcggcgagccagtgtcgttctccgtctccggattcgacattctgtgcatgtacttcttgttaggccacgtctcgccccagtctcgggcgccgagcccgagcgtcagcttcagcatcttctcggcaccgatcgacaggagcgacaacaccacggcggcctgcccgaagtcgtgccgcatcggaagtcgagggtgcccagatgcgcgatctggtcgcgtttcaacgaccgctgatgctcgtagtggaactgctcagcacacccaagacccaggcgacgaagccatccaccaggttaagtagctctgtggatttgtaagactaccctgggctcatggaccgacttcagccgcgacaccagatcgcaatcgatgcggccgttggcggagcactggctgcgatcggcgccgctgccggtggcccccttggagcaggcctggcccaagcggcaacaccagcggtatcagccgtaatgagccaaataattaccaccctcgccgatagcagcgcaagccgcacaaaccggaccatgaccagcgccgcacgaaccgccggagtcgacgagcacaccctcgccgagcagatgcttctatacagatctaaagcggtccttttgggcagagcccttgatggtgcggcgcgtagcatcgccgaagagaagatcgagtggttcgccaactgcatcgcaaacggatacctggctgcagacgatgccgccgtagaccgtgaatccttctacgtcagtgccttcgccgagctggaggccccacatatccgagttttgctcttcatcgccgagtgggagcgagtcggcgaccacgccgctcccccgactactgatgagctgtcagatgccttctcgcggcagctgtgtccggtgatcagacccgttctcaccacgctggagcgggcagggctggtggtgaagcgacgcgcccattcgagcgacgagaagatggcgtcgcagcgcgagaccggcgttccccacatctgggagataaccaccttcgctactcacctcctgcggcggataggacatacgccaccggaccgagtccggccctcccaggatgatcttctagaggcagccaatgcaggccagccagtgccgacgacgtcagcgaccgatgtcagcggtgccacgaatctctaaccaggcagctcacagtgcgggaaaggtaatgggctggcgtgcgaccggagcagccgggacgcggctctcaaccgcgcaggtcgaggccgaaaagctcgataagccttcgctggccttcctcagtgagcccgacgcccaactcgggcggcaacagttcgcgtacggccgacggagctgactcgtccactggctcggtggtgatccacccttgcaataccgcctcgtggatgaactcagtaaggtcggcaggcggggcagaggcgggcgcaatgatcgacttgccgccgcggacgtccgccgcgtcggcgaacacgacccggcggaggtccccgtagtgcgaccgctgcggcattccggcgggcaggatcggggcgagcgcctcaaacacgcgctgaacggccccagcggaccactcgtcgtaggagctcgttgcccgcagcagcacgccgcccctggccagcggcacaacccggtcgaaggcggcaacggcaacgtgcggggcaagctcggccgggcagaccgtggcccattcgtagccgcgcagcacgctgcgggcggcgcgggccgactcctgcacggaacgactcagtgcgatgtctaacgcggtgcgatgtagatgtcccgtacgtccgactgttacctcgccgtaagccggctcagccgacactgcgacatcccgcaggacatcgtacgccgcctcgaccacctcgttgagccggctggtgtccgcgcccagcgtcgccgagacgtgcagcactgcctgcccgtcaccgtcgaaccactccacggtgacgcgcagcgccgatagcacgccgacgcccgtcggctcgatgcgttcgagccgaccgaccggcatcaccggcgtcgggtccgcatcgacgtaaggctccggaggcaccggcccgaggagcggggtgaggctttgatcggcgatcgcacgccagcggcgccaggccggctccacccggtcacgcccggccacgcggtccaggtagagccgggcgaacacgacgggcggctcgggctggttgctctcgatccagaacgggacgatggcatcctcgtaacactcgtccggctccgtcatcacagacccctcggtgctaccccgtcgaggcgccggagaaatacccgcatgactgcttcggcgccgtggtcgacaggctatcccatgtctggctcggccccgcgcgatgggctgtcgctcgcttcctgagcgagcagccaatccgcgaacttcgcggcctcgatgaggcatccgtaggcgaacggatgctcgtccgcggcctgttcccgctcagcattcaccagccggccggaccacgcatccatgaccggaacgggggtaatccggcaccctgcgaacgctgcgggtttcgattcctgttcggccctctgttccgcccgggttcgatggagacaacactgaacgtgtccgggacctcgatgatcctggccaaggccgcaaggccaggaattggtcttccgcgaaggtttcctcgctggtaagcacacgcccgatcaagttctcgtcgtatggcaggtgcgccgcttgcacccatgccgctgccgctgtcgttgcggcttccggcgccacagcgggagcgccgtacgcggctgccctttccgggttcagcacgccggaccaccgcgcacctgccggcgcggccgcttccacaacggcgcagtcgctgtccaggatgtacgccccgacaaccggcgcctgagtttgagcggccacggccgccaccgcgcgcacaagatccggttccgcaccgaaaacttggcggaccagccagccgtggtggtcgtcagcgagaccgcccgaatgcagcggttccacgtggtgaaggcctgcgccgcgcgcaacgcttcggcgccaccgagcctgtcggccaattcttgggggcaaatcgtcagccacgaatacccgcgcagaacctgcctgctgttgggcacggtgtcttccggcagccggggcgggacgagcgagcgctcaagcgcagtttcctccgagcagatcgtcgtagtcgcactgcccgaacgccgggttcgcctggtcggccaccgacttgacgaacgtgagaagcgagcgctggaactccggtcgtgctagatgcaaggtgagctactgatcagataggcgtctacccggccgttgtcgcggtggatgacttcgatgctgatgcggaactcgtcggggtactcgacgccgaaccgggcgagtttcggatcgtcgcgctcgtcgcgcaggatcttgtaccccttgccggtccagtagccggccagggtggggacggcctgctgtaccggccagccctttggatactcgatggcgtactggttttcgacgaaggtgcggtcgccgttgtcctcgcatcgcagcttgggctcgttgagcgtcaccttcaaactcgcaccggacggcagctgctgcagggcttcctgcgcccggtcggcgacccgctgctcggcttcgtgttgggtgacgttggattgggatggcacggaggaatcacatccgacggtcagggccgccacggtcagcgcggcggcgaggatccgggcgaggcggcttgcgcgcatcagtgcactctgtctggttggcccgtcacgatgaaagtgatcgagctgcgggccgggttgaggttgtccccatactgcgagtgcgccgcgaccgggttcagcgatccatccgagctagtgaagacgcggccgccgaagccgggattagcagggttctccccaaaacgcatgttgtcctcgatgccggtcaggcagatgacgtcgttgccggcggttgccgcccacacgtcctgggccgccttcgaaccagcccccgtcggccaggcatgagccagatcgcgggtacctcggatcagctcctccgccgcaacctttgagacttggcggtggctgcttgctgtccacggacaaaccgcaccggcccagcagctcagaacggatctcctgctggagtactagtcgggtgtctattttgtgctcgcgttaggagcagttagggcaaggtggcgtttcggagttctttggcctggctgacgagatcgacggcggcggaatcccaggtgggatgggtgaatgtgaatccgttgtcgagtaggcgaccgggtactacgcgtcggcttttaagcagcagctcagtgtccgtgcgcaacgcgaacgcaccgatttccgccatctgccgggtggccggcagaccgaatcggcgcccccaggcgcggcggagcgatcgcatgaggtcccgctgcgtgaccgggtgaggactggccaggttgaccgggccgtccaactcctggtggtcgatgaggaacagtacggcacgaatgaagtcgtcgccgtggatccacgacacatactgcccgccgccatcgacgggaccgcccagccccagccgggtcagccgggacaagtagtcgaaaatcccgccgcggtcgggagtcatgaccatcgccgtgcgcagcgccacccgccgggtggaaacagtgtcggccgccgcttgctcccgctcccaccggcgcgcgatccggacactgtattcccagtacaggggcacgtcgggttcttctccgccgatgatgccgttggcctcatcgtggggcaggtcgtcgggtcggctgcgggcgtcggcgtagatggtggcggtgctggcctgtagccagaccctcggagcctgagccgcccgggcgatggcctcaccgacgacccgggtggactcgatccgagaattcatcatctggcgcaggttggcgtcgttgtagcggcagctcaccgtccggcccgccaggttgacgaccgcgtcggccccttccacctcgcgcgcccactcgcccagggttcggccgtcccagactacgtgccggacccccttctcaagcgtctgcggccgacggctcagaacggtgacctggtcgccgcgggccgccaatgcccgccgtagtacgccgccgacctgaccggtcccgcccggaatgatgaccttcatgatagagctccttacagtgctcttgagcagtcgcttaaatccagcttagatcagcttgagcgatcgctcaacaccgaggaaatgtctgattaacgcattttgcgtgttctgcgattgggggtcgccagattgaggtgtgttcgtccgtgagccggcaggcgagattgtcgatcatggcgaaggtgatcaggggttcggagctgccgggcagggtctcgtagacgcgggcgaggccgcagtggcgcctgagccagccgaggctgcgctcgacggcccagcgtcgtttgacgacgctgaagtctttgacctgtgagtctttggtgacgatctcgcggggttgaccggctcgcatctgcaatcctgcggcccgggtacttcgagccgcaggacgtcgtcaccgtcaaggcagcagcggcacgccggtcagcagggccagcggatggtgatccggggcggcgggaccagggctcagcggcccgaggggtccgtggcctccggggatttccgtcagcgctacccggcgccctaccgatccggccagccaccacaccggctcggccgggttctgtccggccccgagcacgcaggtggccacggtgactccggtgaccatgagtttggcgtgcaggtgttcttcgcgggcgcggctcgggagggcgaacagcaccggatacccgggtcccccgtcggcctgcaggcgccggtaggcgcccagtttgtcgacgagccgggtcagggattcggtgccgcggtcgagttcgaggaagaagccggtctcccctgccgggtcccgccacacgccgtgcccgtcggggtgcacccgccggccgaacgcggccgccgtcgtccgttcggaccaccagcggaccaggtcggcttcgccgggccggcggcgggcctcggcgagcaggtcgacgaagaactggttggcttcgagcaaatgatccagatacgggctggcatacgcccggtcctgccggtcgcgcagcgcccgggcggttggcgggttgtcgccgcgggcgagcgccacataccgcgcggacagcggtccgggtacccagcaggcggggttgggtgcgccgggtcggttgcggatgaagcggtcgacgaagcggagccggcgcagggcgtgcagccggtgccggcaggtggtggggtggtcgaacaggatggtggcgagctggtcggtggtcagggtgctgtgctcgtcgagcaggttcgcgatggtgtagtcgcgcacgcgtaggcggtgggagatggaaagtaggctgcttccccgttcgggagtttccccttcaggaaactgtcggggcggcatggcggcgttcatggtgcctcccagctgcggtgttgggtggtgccgggccggccgtacggggccgggacccggccggggcccgggccggcccgcggtccgggttcaggccagcgcctcccgcagcttctgggcggtgcccagcggcggtcgcggggcggggctgcgcagggtgaaggccggggtttcccggccgtcgacgacgagccggcaggcggcggtgtaggcgtcgaggtgggccaggtcgtgctcgtcgagttcgggcagggtgtgtttggccagttgggcggcgtcttcgggggcgcaggagaagaacactttgttgcgggcgttggcggagatcgccagctgggtttcgcggggcatctgcgccaggttctggtgggcgagggtcaggccgagtccgtagccccgggcttcggcgagcatgtcgccgatcgagccgggcaggttgagaaaattgtgggcttcgtcgatgtagacggcggcgtcgcggcgcttttcttgggggattttggcgcgggcggttgccgcctgccaggcgctggccagaacgaaggagcccatgacacgcgcggtttcctcaccgatctgacctttcgggaggcgggcgagcaggatgccgccgtcgaggatgcggcgcatgtcgaagctggagcgcggcgatccgaaggtggtgcgcacgaagtcgcgcagcagcagggaccgcagccgggccaggacgggggcgatgacggtggagcgcagctgggcggggctggtctcgtaccagctccagtagccgccgagcccggccggatcgttgagatcctgggtgaatttgcggcggaattcgcgttcgttgagtagttcggggacctgggtgagggtggcgccgggtttgcggagcagggtcaggcaggccacgcgcagggtgtcgtcgatgcgcggcccccagtgtttggcgaagatccgaccgaagatgctgaccacgttgtcgacgaccaggtcgtggtcatcgccttcgagcgggttcagcgtcggtccgccgggctggtcggggtcgaggagcaccaggcggcgcgcgcaggtcagcgggatccggtcgagcagatcggtgaccaggtcgcccttggggtcgatgacgacggtgccgcggccggcgtgaatgtcgtcgaggatcaggttgagcagcagggtgctcttgccggagccggtcgacccgagcacgtgcagatgatgcctggcgtcagcggcgcgtagcgcgacggcgtgcccgccgacttcggcgcggccgaggcttttggtggcgcgcccgccggtggcgatgccgaccggtgccggcatcgctttggctcgggcgcgatcgagtccgggtacggcgatgtcgcggggcagtccggccagcatggccagctcgacgggggtgagcacgaacccgtgccggagccggcgcccggtgaccagggtgacggcttggcgtagccggcgggcacgcatccggttgcggccggtgaacggtccgaacgcggtcgcgacggctcgggcgaggacccgcatgcgggccgggtcgtcacgggtcgaggtgaccgcgtagcgtaccgccacttcccagtgcgggccggccagttggtcaagggcggcgcgggcgtcacgctcccgttggggatcagcggacacggcaggccgcccgaccggacggggctgcccaccggcgacgagatcgagggccgcgagcgcccagccggccgggtccagcaggctgcgcgcggccggggcgccccgcagtgcccgtacgccggcaatcagcctgcgccgggaccgcccggcggcgggccgagccaggacctgcacgcaggcttgctcgccggtgcgcagcccggcggccgcgctgatcagggtgcgcagtgggtcgtcgcggtggtcggtgcgcagcggataccagccgggcagcaccggtgccagcgaagctccggcggccgccgccggctgcggcggcaggggcggttcggcgtcgccgacccggcaggcggcacccggccaggcgccgcggacggcggccagtaccggttcgacggcgaccgcgcgcggcagccatacggcgatgcgtagccggcggccgtcccaccggtattcgtaggccgtccacagccggccaagacgcagccgttgccgccagccggtctgcaggacagcggcgagggtggcccagaagaccaccgcaccggccgcatcgacctggggtggtgggctgatcagcacctgccggccgccggtcgcggtgcggcggccgcggtgttcaccccacaccagcaggacagcacccgacacgacggtgagcagggcggacagcccaacaacaatggcgatcacggttggccttcttcgaggtcgaggtcgccggtgcacagccggtgttcggcgggtgaggcgacgacgtggaagccgacacggtgggtgccggacagcagcagcgcttcaccgcggcgggcggtcagcagggtgcgggcctcgccggcactgagtgcgaacgcgtcggtgaccaggtcgatggcttgtggggcctggcgcagcagtacctgggtggcggcgttggcgatgacgatctgcccgaggtcgctgcccagcacgtcgaggacgtcctgggagcagacgagcagtccggcgcgacgtttgcgggcctgtttggccagccgggccaggaagcgggcgccttcgccctcgcgcatcagcgtccacgcctcgtcgaccacgacaaggcgtcgcggcgcccgggtcgggtcggtaaccgggttgtcgacgtcgcgccagatcgcgtccagcgcgaggagcatcccggcggggcgcagttcgtcggccagggcccgggtcgaccagcacaccagctggccggtgggcacggtggtggtcggtccgtcgaacaggtcccggaaggagccgtgagtccacggcatgagccgggccgccaggttctccccggccgtggtgttctggttgagcagcgccccggccacgtcgcgcagcagcggcgccggccgccgccaggtggtcgggtcgctggtgatgccggctttgtcgtaggcgtcgacgacggcccggtccagggcggcccgctcggccggcggtggttgttcgccgagcagtacggcgatcagggtgtgcaggaacagggcgcgccgggtgcgggcctggtcgcgtcgatcatcggcggggatgtcgagcgggttgaggcgcacgccgccggtgccgaggacgatcggggcgccgccgacggcttcggtcaggcgcaggtattcgttctccgggtcgatgacggcgacgtgcacgccgtcggccagcgaccgcagcacctcgagtttgacgaagtacgacttgccgctgccgctgcgggccagcaccaccccgttggcgttctgttctgaccagcggtcccaccagacgacgccgtgcgaggcccggttaagcccgtacaggatgccgccggcgggtcccggccggcccggcagtggggccggcaggtccgcgcccgcgagggggaaagcggcggccagcgccccggtgtccataatccgccgggcgtgcagggtgtcggtggccagcggcagtccgctctgccagccttccagctgccgccacgtcgccggttgggtgtccagcagcacggaggcggcggtggcccgcacgtgcgcgaccgcttcccgtagttcctgcgggctgggtgcggtcacgcacaggtacaggccgacccggaacagtttggactcgccacgggcgacccgctcggccaggtcggcggcgtcgtcggcggccgcgtcggtcagcgggtcactgacccggccgcggccggcgtcgtgcagccggctcgattccagccgggcccgctgccggcgcagccgggatgcggccgccggcgccgacagtggatcgacgtacagaaccacgtcgaggcggccgggccaggacagcagcgggtcgagccaggccgggccgacctcggccgggtagccggtgacgatcagcgtcgccgtgtatccgtcggcgacctgcacgtggtcgggatgggcgtgcgtgacggccggcccgggcacctgcatgtcgcggttcatgccgcaccgccgcgggtgatcggctgctgcggcagggcccgcgaccagccggtgtcggccggcgtgtacgggtccgccgcgcaggtcagcaccgccagcgcggcgccaccgtcgaggaccgcggtgctcgccccgagggtggccagcacactggcggtgtgttcggcgtgccgcagcgcctgccccggttgggcggccgggtgcgcgaccgtgaccgtgcgccacagcgggtcccgctgctcggccagccggcccaggaattgcgcgtagtcacgggcgaccgcggccagccccggctgggtgatggtcgccgcggtgtccaggacgcgctgcgcctgccgggacaggtcgacccggcgggtcgacacgacgatctgcaccggcgtggacaggctgttgagccaccgtccgtagccgtcgatcagcgcggtctgctcgtcggcggtgcgcagggcgatgttgacggtggtgcagccgaccagcgtcaccgactgcgacccggtgtcgatcaccccgtcgtcaccgacactcgccgcgacgggtgtggcgacctgccggcgcggccggcgacggaaccgcagcgcggcccacagccaaccgtcgagcggcagaccgtcacgccggcccagtgccagcgcgagcaccgccccggccggcggaaccagcacacccaccaccaccggcgccggcagcagccgggccaggaccgtgaacaggccgtagccgagcacggccgccaccgccaggatcgccagctgccgggcagtgagcccgtacgcaatcttgtcgggggtgtcgatgtcggccggaatccgcgcccgcagcggcgcgccgacgtcctcgctcatcgccgcccccggccgtggccgccgccgaacggcggcatcgtccgggtcttccccatccgcacccgggccaggccggtgatctgctgcagcaccgcgaaccgcagcacgccgggaatccggctcggcgcggaccgcagcacgaatttgccgatcagcccgggaatccgcagcgtgccccacagcagacacaccacgaccagcaggttcatcgccgcgcccggcttaccggtcaggcccagtgccgggatgaccgtctgcggcgccagcatcacctgcagggtggtgtgcagggcgaccgcctgcaggaccacggtcgccggagcggcgagcatcgcccgccaccacagcttcgcgaccggttcggtctgcaccgtcgcgtgcatcgccagggcgatcggcgcggtgccggccagcaggatcagcagccctgcccggctgacccactgcaccaccagcatcagcgccagcaccgccacgcccgcgccgatgatcaggatcaggaagtcctccgggctgctgccggtcatgccgttggtcgcctcgaaaaccgcggcctgcagctgcggaaccggggacgcgccccgcccgccggccagcgccgtggtcagcgcgttcgccgtgtccaccaccgccgtacagatcggccgcgcgctgttggccgcgaccagcccgacgaccagccgcggaatcatctccccgaggccggactgctgctgcagccactcccggttcatcaccagcacgccgacccagacgaaggccagcacgtagcaggtgtcgacgacgccgagcgacgtggtcatcagcgtgtccacctgcggaagggcggtgacgtccggcaccaccagcacggtcgtcgacagcagccgccatgtcagggccaggccggccagcaccagggccgacagcgcgcccagcagcggcccgagaacaccggagagcgcccacccgaccgacatcaggacgccccgatcaggcccttgagcacggtcaggaacaccggcgccagtaccgcgaccgcgtatccgatcagtgcacaccggaacgccgtcttggcccgctccacctcgccggtgtccccgttggccagcatgtaccggatcccggcgagagtcagaaacagagtggcgaccgccgccgcgatcccgatcacccagatccggatgttggcgatgatctgcggcagctcgtacaccgcgagaaccatgaggcaccgtccttagcgaggaagcggcaccgatcgatgccgcacctcaccaagggccgctgtccggcagcgtcgagcaccggacaacaacccgtcagcgccccacaaccgccgacgaccttcaaacccctattgctgtgtacggtggctgtcggccgacagccgcgcctcgtcggccgacagccgccctcaggccgcggccttggtcgtcagggtcggccgcccgtcgcctgatcgccgggggcgcagcgcgatatgggccagctctccgtcccggatcgcctcccgcagccgctgctccgcctgcgcccgccacgccgacgccagccgcgcgggaagccccagccgctcccccgcgacactgagcgtctccccctccagccgggtcgccgcgatcagatgcgcctcgtccgcgtcgaccacccccgcggccacggcccgcgccaggacgaagtccgggtgatccgccggccgcgccggaaccgccgggcccggcacaccagccatcccgaacgaccgttcccccggcacatgacgcgcccgccgcgccgcccggaccccggcgtcgatcagacgaccacagatccgcggcgcttccacgtccacccggcggagcgccgccacgaagccggccagcagctccgcgtccaggtcctcactgtcgccggatcggccggcgcacagtgcgcccgccgcgcggcgcagccccggcatggccacacccaccgcgccgaccacccagcccggcccgtccgccctggcccgcaggaccagctcccgccacacggcatcgcgctgcagcggcccggtccgggaactcagcagcaggcctcgcagccgatccagcggcaccaccccggccaccgtgccgctatccagcaccagcggggtcggcggcgccaccagcagtacaaacgcccgctgcgccaccgccagcggcgacccgctccagcttcgaccacccatgacaacctcgcaaacaagatccggccccggccacctgccaaggctcggatctcatccgcgcacaccgatccgacaccgccgactgttgccggacactcaacggtggtgttggttcagaagccgatgtgtcggggtgatgccgttcgcgtcgagaaacacccgcatccactgcgccaacacggcgatcaggtcatcgtcgaggaacacctcagcgcgttcggccaactggtccgctgtccgctccgccaacagccgggcgaaatcttcgacagtctcctctttcatgggcggctccggcagtttgccggcatgccattcccggatccactcctccacctggtgcgcccaccagacccgtcccatcttgagttcctgaaaaggggccgggaagtcatcgcggtcggccaactgttggatccgctgtcgggagagaccgagccggatcgcgatctcccgggcgccgaccaggcgcaacgaatcgctgagttcgcgagccgaagcttgatgcaccactgcgcgctgcatggcctatccctcgtgcctgatcagctcgtagtggccatgcgcgttgtggcgcaccgcgacctcctgccggcccggtcccgacgcaccgagcaccgcggcgacgaaccggcgcagcgccaccggaatctcctctggatgtgggcgcaggaagatgatgccgcgacgctcgtccagactcagcccgcagatgtccagcgggatcccgtcgagcttgatctgcacctcggtgtccaagccaatcgcggtcaacgccgcgatcagcccgctctgcgtaatcatgagtgtcctttcgtggggacggacagattgaccggcaaggtgaaccccgtcggtggacacggccgggcagcgcttgaccggctcggctctgcgctccgggaggggaggaggcgcggcccgccgacccgtacggcgccgaccagttcggggcgagtcgcaccgggccggcggaccggtagtcgcagggtgcgcgagaagatcaccaccgcgttctcgcgcagccgacacgggccgaggcagccgcaagccacgcagcggcccgtcgcactcgaggtcacatgctcgtccagaatcgcctgcgcctgacgcagctgcctccgcgccgcaaccgcgtagtacgtggtcttcccggtcattgctcgcctcccgtccgcgccagaagcgcgccaaactcgcccggctcgcggacatccgccgccacccggtggatctggaaaccaccatggacggctgcccgacgtcggtgaaggcactcagcccgggagggatggggaggcaccaggaggggatggatcccggcgtcctcccggatgcgacgtctatcgaccggcagattcaacgcggttcgctgcgcagagcttgtccgcaaatctttactgttgaatgtgctgcgctgggcggaggcgtatttgacccgtactcatgtccggcggctacgcccggcagcagagttgacgcgactacgccgccttcgcgaactctcgtttgatcaacttgcccgcgccgcggggctgccgcggaccaccgtctcccggctcgaaaaagcgcggaagaggccggacgccgacgacgtcatgcgcctcctccaagcatcgacggcgatcagtggctccagctcatgacgatcgcccgggaagccggcgagcgcggctggtcggagtcctgggccaacaagatgggaagccggcaggctctctacgccaatctggaagccggcgccgccacgatccgcgagtaccagatgactttcctgccaagcctgctgcaaaccccggcgttcagcgagcagcgcgcccagctcgacaccgccgactggtcgtcacggttcagcccggcccgcgcggtcgaagcacgcgagcgacgccagcgcatgctgcgccgtctcgatggaccgcggtacgaggtcgtcatcgaccagctggccatccggcggccggccgccaccaccgacgttcttcaggccaagtcgtgcacatcgcggacctggcgacccgggacgagaagatcaccgtgaaggtgctgccgatcgaccgcgcaaaccgacaggagtagcagcgtgactgacccaagcttcacccagtggcggacatcatcgcgcagcagcggcggtgcgaactgcgtggaagtctcccccgccgacaacgccccactcatcgcggtccgggacaccaagaaccgcagcggcggcatgctggtcttcactgggaggacatgggcggacttcatcgccgttgtgcgagcgggcgagttcgactgaccgtgtgaaccagccaggttcgaccgggcacgtcgagcaacatgtggtcgtccggaagacgtcaatcacgcctggacggttgatgtcgacctctcacggtgccatcctgtcgtcacggaggcgctgaacagttcagctgacgcgccgtccacgacatctttgacctcgcggaggccgtcgtgccgagtgccgaccccgagcccaacctgctcctcatccaggctcgcgaacggcgagagtcgcccacccagcccggcgagcccatgtcccgggccgagctggccaccgaagtcagcagaatcttgttccccgacccgcgccagcggatcgccagccccttcaacgccaactacgtcggcaaacttgaaagcggtaccatcggccggccgaaccgccccgactaccgggcggcacttcgcagagtgcttcgagcctcatcggacgaagaactcggcttcgccaaccgcaaaacgtggatacctgcccggcaagccagcgtcgaggacccggttcccgcctctgcaatcgcagcggaaagcagcatgttcggagccttcgaatcgatcgaaaatccgtcagggatcatcattggtaaatcgggagactggaacagcttctccttggtcaccagcatgctggcacaacaacggcaaagcgtcgagccgattgccctattgagactggtagaggctcatcgcgagtgcctttcaacacttttccgcaatgccgggacagaccctgtacggaagactatcggccacatgctcggcgaagcatcgatagttgctagccgcctctggagcgctcacggaaaccgcaacatggcattggctcattgcgcttacgccaaacaactcgcggagcggatagacgatgtcgcgctcggggccacggcacggatatttggcagcaatcttcattctgaggcctccaccctaattggccccgacggcgatgtcatggtgggcctgcggctacttgaggaggccgccaccgtttccgaacggttgacgccggccgcacgcgctcggatcgctgcggagcaggcccagacgtatgcatcactcaggctgcaccgaccagccgaggaagccctcgatcgcgcccacgaagccgccggagacatcaccagtgaagaccgcgtcgggttgtacagtgactggaaccgcagtcgagtagaggtctacgacggcacctgccgcctactgctcggtgacccggagaaagcggttgccattctcgagcccgccatccatgaactggcgacagattcgcagaataccaacgtagtcatggcagcacaggtcgacctagccagttcctatgccgaactcggcgagcccgaaatgagctgcaaacttctcggcgaaacctatggacggctccgcgaagtcggtaaccttcgcggcataatgcgtgcacgacggtcgcgagaccgactggcccactgggaaggcaagcaagttgtccaagaactcgacgtccgcatgaagtcatgcctagctggccgagccgccggataggacagattccacggtggcgacaatagtggaaggttcaagatcctccactattgcatccggcccatactctgcaagttcctcacgagtcgaacgatgcgcaacgacaatcactttgaaaccggcgtgccgcgcacaggcgatatcgttgggagcatcgccgatgataaccgtccgagccggcacgagttgccttccgaaggcgtttgcgaatcgccgagccaccacggcaggcaaattgaagcgatctctactatccgagccgaaggcgccgatatcgaggtccaagtaggcatctaggcccaattcaccgagcttcacctcggtagccggccgaatgttgccggtcaacaccgtctgagtaaatccggctctgttcaattcaccgatgctgccgacggcacccgggtacggtggctgatccgatcgaagctcatcgcgaccttcgttcatcaccgacatcaggctggttgaaaagtccgcgatccctgcttcagctagcgcaggagtgacgcccgacgcgatagcagtgtcgatggcgatcgactcgtccgtatacccgtgaaccttcttcgccgggaaccggacctctgcctccgcgaggccgtaggctcgagcgatcgctcgccgaagccagcggaggtccgccggaatgagagttccgtcgatgtcccaaaccactagcccaggttctttaggagccacagtggcattgtttcacactacgggacgcacgatccgtccgctcggacaccaccactgagcgtcgaaggcggacaagggcgacaacctcaggcgaccctagaatcctggcaccaatcggttacacgctgcacgatcaacctccggcttcggcgttcttgagcatggcgccaagctgtcggtaggcgtcgttgttctggacgatcagctcggcatgtgccatgccgtggggattcgggtgattagcgtgcaagccgctgaccggctcggagctggtgtagctcctgctgcaggatttcccgggtccccgacgggctggtcgccgcgacactgatgcgcgccagcgacccccatccccatggaccgccaaccctgccgtccagcaggcagcgcaagccagcgactacgccacgatcctgcgactgtctcgtgtcgcggccggtcccacactggaacagctcagcaaggcatccggctattcgatatcaactctgtcccgcctggaaagcggccgtcgccggatccgggacgtcgccgaggtctgggcactggctcacctgtacgacgtaccggtgcagttgttcggcctggcacctgccccaaccgacgatgacgggtctaccctgaccaagaccgccgacggagggggcgacactgtgcaccgacgtaactttctcgccggcgcagccgccgtcggcgccgccgcgctgccagtgctgccaccttcggcgtcggcagcagccggcgacaccattcaggacatgctgttcggacgattggccgccgaaccgctccccgcccagcaattagctgcacaaattgcggcagcccgcgctgactttcgtgccgcccgatacacccggctcgcccgccgcttgccgaggctgctcgcacaggcagccgccagccgttccgcagccggcaccggcgcagaggccgcagccgcgcaacggcttgccgaggcctacggcatcgccacccagctattgatcaagctgcatgacgacagcatggcctgcgccaccgccgatcgggccgtccaagccgccgccggaaactgcccactgatcatggctgatagtcagcgactggccgccaccgtcctgcgccgggccgggcaccgcgacagcgcccagcaactggttctctcggccgcacgccaactgtacgacgtcggggaatcagggcctgccgcccaagcgatgtacggacagctgctcgcggtcgccgcctacaccgcggccatgcgcgatgaccgtgacgcggcttgggcgctgctagaacaggcccaagagccagcaaacgcggccggggccacagctcgcttcaacggcaacgaaatcgcggtctaccggatcagcatcgctcggaccctcggcgactacggtgccgccgtcgactacgcccgcaaagtcaatctcaaggccattgtcgcccccgagcgccgggcaaggtactgggaagacaccgcgctcgcctcgcaaggccgaaggcggcccggtgccgcattcgaagcgctgctggccgccgaacacgacgtacccgaagaggtgcgataccggccgtgggcgcaaaacctcacccgggaactgctgtcatctccggcagcctacggtctgaccggggtgcgggaatacgccgccagaatcggcgtcgtttgacaatcagatccaagttcttcccgcgcctggtggaggccagaaaaaccgagtcgatctgttcgcacatgacctcgggactgaagccacctcggaatgccgctgggcctgccccgtcctgactgaccgcaaatatgcagaggattgaccgggtggcgcacgagggcctgcggcgccggccgctgcggcgacgcacgctcatccctcacgtcgagtaatcagtcggcgcggggctgccgcccggatcgcgatcacatcggtgcgtccgggcggctcgttgactcgcgctggtccctggcggtgtgctggtcagccgcgggccaggtgcaggccgatgttcgcgcccagcccctggccgtaggcgagctggatgagcagttcgacggtcggctccagatagcgggcgttggtcagcgggccggcgtcgatcgcgtcgaagccgagctgattgccgaggccgatcacggtgttcttggcgtccgcgtcgtcaccggcgacgggcagcagctgcgccgagccgcccagggtcggggtgcccagggtcgcggcgaagacggtgttgaaggccttgacgacgcgggactgaggcagccgggcggcgatctgctcaccggcggaggtggtgtggccgacggtgagggacatgaagtcggcggcgagcgggttcgtcgcgtcgatcacgaccttgccggcgagcgcggcgcggacctcgtcggtgaacaggtcgccgaccgcggagtacggcacggcgatcacggccagatcggccgccgcggcggcgtcggcggcggtggcggtgtccgcgccggaggccgccgcggcggcggccagccgcgacgatccgggatcgctggcggcgagcgtgacgtggtggcccagcgcggtgaggcgggcggcgagggcggatccgacgttgccggcgccgagcactgcgaacttcatggtggtctccttgcgtggtgcgtgatcccggaagccgggccgttcgaattcgaactaccgcgaacgctacacgtcgttcgaattcgaatcaactgctatcgtgatcacatgacgcagcgatggctcgacgagatcgagatgcaggcctgggtggccttcctggacaccagcaacctgctgcaacgacgtatcgaccagcagctgcgtgaggacggcgggctcacccagccgcagtacgagctgctcacccgtctcgccgaggcaccgcagcaacgcatgcggatggcggaactcgccctcgccctggtcacctcccgcagtgggctcacctaccaggtcagccagctacagaaggccggactggtccgccgcgaagcctgcgccggggatgaccgcggcgtctacgcggtcctcaccgagcagggcagccaggcattgcatcgggccgcccccggccacctgcgcgtggtccgcgagaatctgatcgacctgctcgaccgcgaccaactggtcaccctcgccgacaccctcagccgcgcacgcgcccatctccgcatgaccgaggacgacgaaccccgccgcaacggctcgagctgaaccaggactcgcttcgccagacgcgctcgcctcggctccggacgctgaggagcggtcaaccagtagaagatctgggtctacggcggtctgcgcattcgcgacgggcacgcggtcacggtgtgcgccgaccagcatgccgctcaccgcgtgcagtcgcacagccggtacggccaagccgacttggcggcgcctacggtaaccccccggcgcgggaacctgtcccgcgcgggtggcgtgcagcaaacgctcgatgatctggttggaaggcacatggttcaccgcgtctccggcgagaccttccaacgggtcgtcgactctgcactcgacgacgaacacggggtgttcgtccacggcctgtccgacaaggtccccacctccctcgtgctttttgctcatggcctcaacggacatcgctacaagacctgggagaacttcccggaatttctactgcaggcgcgcaccgatctggacgtcggattgtacgggtacaccagtgggatcaaacgctatgcacgacgcgacatggttgatctgggtgcacaggcacagcatttcgccagtcagctgagaatgctcgaatatcaccgcatcgtcctggtcggccacagcatgggtggcctgttgtgcatgggcgcggtgcgggagctgctcgaggaccgcctcaccggtgacgacccgcagccggccatcgaccgcatcagcggcctcttcctgctggccacgccgctggccggatcgctgcgggtgcgatggccgttgagctggaccgtcgacggaaaggtgctgcgcgcgcactccgactatgtgggcggcctgcaccgaacattcgccgaccgggtcgaaatgaacggccgcccgccaagcgaccaccacaagatctggttaccgacgttcagcgcttccgccaccctggaccgattggtcgacaaaatgagctcccgcctcggtgtgcctgcatcacagtgcacatacgtgcgaggcagccacacgtcgattgtcaagccgcgatcaccggggagtgacatcttcacgtggttctgcagcaaacttgaccgctgccttgtggatccggagggtggtcccccaccattgggacttagggtacccacacaacgtgagggtggtcaggttcccggcggcaccgctcccaaaatccatatcaacatcaccccggatcagatgcccgaggtcgtccgcaccatcgcagccttgcgcctcgaagaggagacgtccatcgacatcaacatcctgccccgtgaaggtgattgacatgatggtgcccccactgccgcccccgccatcctcctggatcgatccacgacgccggatggtcgatttccgaaaacgacgagaattcctggacctggtgacctggtgcaccgaggagccgggcatcgagccgcgggtgcgacttctcgccggcccagcgggaaccggcaagacccgcacagcactggagctccagcaggagctgcagccccatggctggatcgtgcatctgctggaggaaccgtacgaggcgatcgaggtcgtcggccagtccatcggccagtgcaccaagccttgcctgatcatcgtcgacaatgcggaccgctcacccagcagcatccgccgggtgatggaggcgctctccgagcagggggacacgcctctgcggatactgctgatcgcacgcagcgcagccgtctggtgggaacacctgaccgtgcgcggacccggggcggaactgctggatccccacccgatctggttcaggcacctgaccgccgagtatgcgacggaaatggcccgggccgctttcagcgccgtcactgccggattgggccgggaggtcgccgtcgagcgggcaccgacgcccgtcgcgctcgaccggtcgacatcgatgcttcacgcccagaccagcggagtggtagcagccctggggcccactcgcacgcccggccccgcagaactcctgcgcctagcggatccgatcgatgcgctcctcacgctggaacggcggcatctgaccaagagcgctgctgtacgtcatgtcaccttgcccgacgatcctgcagccgtcgacctgctccttctcgtcgcctggctcacaccgcgccgcgacaccgatctggccgtcacgctgccgtaccgcatcgagaacagccttctccacgtagacggtctcgcccggctactcgccgagctgtaccccgacgcggggccgagatcgcacgacttcgagccctccctgctgcgggaacgtcttctcgaagacctgctgctcacctccccccacccgcacaccctgcagtggatcatgcaaactctcgcgcgtgaccgccggcacgcctcggcacgggcggtcaccctgctgagcagtctgctgctgcaccaggagacggcgccgccagcccggttcatcgccgacatgggcgaactgatccgcgccgatcccgaccgggtggtagcagccgccgtggaggtcgccgtcgcgaaccccaagacctcgcggatacgcgagcacatcacgctgctgctgcgttcctgcccggtgcacagcttgctagcgttggacagcaccatcgacagcttggcccgcacccacccgccggccgcgatgaccgtcgtacagcagctcacgaacgcctgggagaccacgggcatcggaagcgaaccctccgatcggccgagagccgtgcggctgttgaaccgcatcggcatcgggctctctgaggcgggacaggtcgcggacgccctggcctcagcacgcatggccgcaacgctggtgaccgacatgcagatgaccaacgaacaagatcatctcctggtcgccgacaccttcaagttgctcagctatcgcctgtcggagatgctgctcggcaaggaagccttggccgccagcgagcgcgccttggcgacgttcgacccgctacaggacgaggcgctggaatacgcccatctcgtgaagcgggtggagatcgagcgctcacacggcatgcgtctgctcaacctcggccgtcacgaagacgccctgcaatggtgccaagccgccgtgcgccgggccgagggcatcaccggtcggcatccgatcgatcgatcgcggcacgagctggcagcagcgatgacagatctgtccgtggccctgtcggagaacggagcgtacgccgatggctatctgatggcgctacaggcggtatcgattcgccggacgctgaccacccggaatcccaacgccttcctccccgaccatgcgatcgcgttgagcaacctggggctgagactgtcggagatgggcaacctgaggcaggcgctggccaccacggaggaagccgtgtcggcgtggcgacgcctggcgaccctgcaaccggaaacgttcgagccggaactagccgccgccctcaacagtttgagtctgcggctggcggaaaacggtgacgagaccggtgccgaggacgccgcccgtgaggccgaacgcatctggcgccgggtggcgcacaacgctccgacctaccgtccctacctggcggtgtcgctgtccacgctggccgcccgccaacgcgctcaaggggattccggtggggcgtacaccacgctggaagaagcgatccagatctggcgctccgccggtgacaagcaagccccacgtttcactcgccgactcgcagccgcgctgcagaacgccagcatctacctttccgaatcgggcgatccggagaaggcgttcgcatccgcacgcgaatcggtgcgcatctgggagagcgcggcgaaccagtcccgcgtccaccgagcgggcctggcgtcagccatggtgacgtacagcatgcgcgccgccgaactcgggcaccaggaggaagcggtcgacacgatcacccgtgcagtgcgcatctggtcggtgctcgccgatcgcatccccgcgcatcgcggtgactacgccaccgcgctgcacaacttggccattcagatggcccaggtgggacgtaccgacgacgccatttccgcggccgaggaggcagtcgagatcttccagcaattggccgggcagtatgcagaggtgtacaacctcaaactgtcctcggcgcgggtgctctgcggtgcactgctggccaccgtggaccctgatcgcgcggaacaggagatctccgaagcccatcacctggtggagggcatcagtgccagacgggcccggcagaatccgcgcaagctgcaatcgatcaggcaggtggtacagcagttggccgggtagccgctaccaccgcatccgcgccgctgaaggagacggtcctgaacgacttttataccaccttcgcccaggtcttccctgttctcatgctggccatcgtctgggagtcgtcgtttctggacaggctgcgccggcaacagcgactgacccggcgcgaggatccgcacaccggtgtacggttctggaccaaacctcgcgtccgtctctggaccatcaccgtcgtatcgaccgcagtgctcgaactcggactcatcgccctggtgctggcgaatgtggtaccggacgccctggccgcccgcgtcgtggtgttggtgggcctggccgtcgtgctggcgacgatcctgacccgtgccgttgtcgacatcatgggggcaacccgacacgctgcaccggctctctccgtgcagcgcgataccgctggacacggccagggcatgacgtccgcgaaagacgaatcaagccgtcgccgagatcgcgctgagaggacgtctgattaacgcattctggttgctatatggctttagccgtatcgccaggttggggagatttcggcggtgaggcgttcggcgacgttggcgatcaccgcgagggtgatcatgctggcggagttctccgggcggcttcgtagtcgcgaccggcatcgagccacgtgcccgacgcgcaagagtgtcagatcagggcgcggtgagtccgacggcctcgtcgacgcgatcgaggatctcgtcgtcgtggccgaccccgcgcagcaggtcgatcgcggtggcccggatctggccgatgatcatggtcagcggcagggccggctcggactccaggagtttggcggcgatccgtaccgcctccagcgcggtgtgatccgcacggctggcgtgctgctgcggatcgtcggtgccggtcaggtcggtggccagggcctcccccgcggcccggatggcggcggccagtgccccgaacgcccggctgagctcggttggcgccgggacgtccagccggatcagcgtgacggcgttgcgcgccagaacccagatgttgtccacgacgcggtccagttccgcggcggtcgcctccacctgtcctacctggtgcacataccggcgccggcccacccgcagcttcaccgcctccgccgcggccagcacctcgatccccaaccgctccactctggtgcgggccgcccgggcccgacgcaaggcgtcgtccgcggcggcacggtcgccctcgcgcagcgccgcatcgacggtttcgaggagatcggccaggccggtgaaggtctgctgggcctcgcgcaccaacggagcgaggggattgcgagcgacggccagttggctgaccgccagggcgagcgtgccaccgatcagcgcgtcgaggcagcgccactgcatcacgtcgatgcggggttcggccaccgcgaccaggtagatcgccgagatggccgcctgcatgatcagggtggtgctggcccccagggcgatcatcggaccgaccgtcagcaggagaacgacggcgatcgtggccgttcccggcccgaggacctggacactcagatcggcgaccagcactccggcggcgacgccgagcacgatctcgatgctttggcgcagccggcgcccgcgggcctcggcgagcacgaccagtgcggccgacggcgcgaagaccggcgtgggatggccgacgagatgcccggcgacgaaccaggccagcgtggcggccaggaccgcctcgcccgccggcaccgctgcttgcctgagccgcttcgttgccgagcggcttcgccggtggatcgcggtgcggagagagtggatcgctgacagaactatcctcctggagagctgcttacccggcatcggtacgaagtcacgcaggtacccgggcgcagcacatctgtaacgaaacaaatccgacagggccgttaccgcttcccccgtccgtggtgggaagccagcctgctgaccagcccggatccactggcagtcggtgcgcttcgggaagtggtccccgaagggtggttcgcgctcgtgcagcatcgcttcggcttggatcatcgggacgcgtgcagggcccagccggccgcgatgatccgtctggcctgtgggcgggcacatgcggctggccgaaggccgctgcgctaccgggacgtcgagggctggactggcggttgtcgccggcgagacgcttcgtggtcgccgatgtgcccaacgatcagaggagcccgaccgcaacccgaccatggaggaggatgatcgtggccgcagcctctcgtcattcccgtcgcactcgactggcccttgtcccccttgccgcattggcagccgcgacagcagcggcgacgctggcccctacccccgcggccgcggccgtcaagaactcctgcacgatcagcggctgcacggccgccgaaaacgcctacgagggctggtcggagcttggctggccgatcagtcggggctggtactcatggtcaagcggaaagtgcagctacgccggcggggagtactacaacaacaacgggcagttgccgtacggtgacaccttctgggaatacgacgtctacccgcgcaactgcggggcgcaccgcgacgcgtaccggatcgtggtcgacggcgacaccgggcaggcctggtactcccccgaccactacagcgacttccacgaattccggtagcagcccgcggccgtcggcaaccggagattgttacgacatccagttgccgacggccggcttcccaccatcgatgcgcgaagcccttggtcggtcgacgccgatttgaacaggccttcagcttccggggcgcgtgggcggctcgccggcgtatcagccggtgatgaacgccagcccggcgatgccgagggcgtacaggatcaggacggtgagggagtcggcgcccatgcgcagtcgttggcgctggggccggaagaccaggccgaccatgtacacgacggtgagcaggccgccgagggcggtcaggtagatgtcgctgtgatgggcgcgcggcagtacggcctggccggacagcacggtggcgagcaggaacagcacgggcaggaacgcgttgccgccgaagatgtcactgatggcgagctggtagtcgcccatccgggtcgaggtgagcccggtggacacctcgggcagagcggtggcggcggccaggacggtggcgccgaacaggacgccggacatgccgaggcggccgaacagttcttcgccgctgcgttcgatgaacacaccggcaaccagggtgatcgccgccgcgatgccgaaaaccgtcgcggcgcggccggtactgacgcccttggcgctggcctggttctccttggtggttttggagtggccttgagggccttcctgggtgtcgggtgcgtcgccgccctcgtgccagggcagccccttgcctgcgcggcgcagcaacagcagtccgaatccccacaggacggcgatgaggacggcaccgggggtgagccggaacgcgatcaacgagggcggcaactgggtggacatgaccacgaccagcagcagcgccaccaccagggcgccttccagcagcagggtcagggaggcggcgaggtaggtcagcggtttgcggggccggacgccggcggcgtccaggatgaccagcacgacggtctgcagggcgatgccgccgaggatgttgccgacggcgacgtcgagttggtgcgagagggcggcgctggcggtgatcgcgagttccggcaggttggtcgcgatcgcgaggaggatgactccgccgagtgcggtgcccaggtgcaggcgttcggacagtacgtcggtggcgttggacagtttgatcccggagacccagatcgccgcggcgcaggccacgaagatcagcaggagcagccaggagttgagtgagttcacttcacggttcctcgggtgggtgggacaggggctgcggggctcggtcggtcgggggcggtgtcggtgccccagcccagtgaccagttctggtccgggacttcgccggccgctgcggcgaacccgagcagcgctgcgaccaggtctttgcggtttcgcaggggcatgttctgcaggatggcgctgatctgggcgcggcgggccgcggtgacctgccggaccagttcctggccggcctcggtcagcgacacgcacacggcgcggcggtcttgcggtgagggcttgcgccggatcagaccgtggcgttgcagccggtcgcattgccgggtcgcggtggaactgttcacccccagcagggcggccaggtcggccatgcgctgcgggccgtgcgcggcgagcaacaccagggcgcggtgctgcggcagcgtgacctccccgtcaccggcgttcaaggaccgcaccgccaccccgaccagggctcggctggcggtcaggaacgcctcgaccaggtcggcgtccacctcatccgatcgcgagcgtccctccacagaaagctcatgccctgtgcatacatgtcgtatgcacggttactgcagcaatattcaaccgccacctcgataaagccagcggcgccacagcaacgctgcgcgtaggtgagcccgactcagatcctgagggttgtcggcgaatccaccgaaactgcgggttttccggtgtatcagccgatacgttctccgcagggacggtgcttcaccgccacctcgccgagcggacaggttcgatgggtaaggtcctcgtggtcgacgacgagccggatctacggtttctgcatcgacggatcctgagccgggccggccacgaggtgaccgaggcgggtgacggtgcgtccgcgctggaggccgttcggacatccccacccgatctggtggtcaccgacatgatgatgccggtgatgggcggggtcgagttcattcgtcgcttgcgggctgatccggcgacggcgacgatccccgtcctggcagtcagcggcgactggcagctggcaaccgaagccgacgccgcactggccaaaccatgccacagccaggacctgctcgcagcagccgaggacctgctacggaaaggatgtggtgggaggtgacgcgcctgtcgaccggacaagcggacctggacctggtgctcggtggcggcttcgaacgcggatcgatggtcgtcctgtccgggccaccgggagcgggcaagaccatcctggcgcagcagatctgcttcgccgccgccaacgccgatcacaaggccgtctactacacgacgtggtcggaaccgcactccaaactcgtcgagcatctgcgcgagttcacgttcttcgccccggaacggctgggtccgcaggtggagtacgtgcatctggggaacctgctgcgcgacagcgccggcaacgacctcagccccatgatcgacgaggtgatccgcaaagccttcgacgaccggcccgcggtggtggccatcgacagcaccaagatgctgcgcgacttcgtctccgaacacgacatgcggatgtcgctctacgacctgggcagcaaggtcgcacacagcggagcagtgctattgctgctgggcgagtacacctccgaggaggaacagaccggcgccgagttcaccctggccgacgcgatcatgcaactgtcctatcgcccccgcgaaccggtcgaccggcgcgggctacgggtggtcaagatgcgcggcaccggccatctgcaaggcacccacaccgtgcacatcacccgtgacggactgcgggtgtatccgaggatcgagtcgatgctgcccgaggaggtcgcaccgcagcaggaacggatatcgaccgggatcagcggcctcgacgcactcctgggcggcggagtaccgcgtggtgacgccactctggtgttcggaccttcgggtgtcggcaagacgatcggctcgttgcacttcgtcgccgacggactggcccgcgacgaacggtgcctctacatcagcttccaggacactgctgaagaattgatcggcatcgccgaccggctcgggtgggacttcaccgctgcgcgtgaggcaggaaagctgacgatctcgcacgtaccggtcggcaacctcgacctggacggactctcctcggtcgcccgtcaccagctggccgaggccggcaccacccggatcgtgatcgacagcctggccgagatggccttcaccgcgcgcgaggccgaacggttccccgcgtaccttcgcagcctcctcggcctcatccgcaccgccggagcctcgctctgggtcaccagtgaaacccgaaccatcggccccatggaggaacccctggccggcctcatgttcctgttccacaacgtgatccagatccgctacatcgagctctgctccgagatcggccgcgcggtcaacatcctcaagatgcgcaacagcggccatgacagcgctctccacacctaccacgtcaccgacaccggggccgccgtcggcgacaagatcgaaaacgtcaccggtctgctcggctggagcgccctgcgccactgcccgcccacgtcgcccagggacgacgggaactgagatgcagtggatccccggcgactgcccacgcagggtcaggcaggctttgccgacctcggcgtgatcgtcaccgccgccgcgttccacctccgctacgacgcggtgcgccacctcggcgccgaccggctatccggccggatgagccatggtgaggtcggcgtagacgacgatgttgtcctcgtagtgcccggcggtgctgtcgaagtcgccgccgcaggtgatcaggcgcaggccggcgcggttgatcgcgccgtacaccgcatcggtaggaaattcggctttggcgtaacgctcgaccttgacaacggcgaacatcgccacgctgccgtcttcgcggtcgacgtcgatggagtcgccgggcttgaggtcggtaagccggtggaaagtgccgggctgtttccggtagtcgacgtgaccggcgagcacggccgggccgagtgagcccggggtgggcgccccggtgtaccagccgacggttctggcgtcggtgggcacctgcatggtgccgtcggcctgccgaccgaggccggtcagcggcacgtcgacgtcgagggcggggatgaccacccgggtcggtttcgacgtgctcatcagcggaccgctggtcagctcaccattgccggcagccgggagcgcggtctcgggagctgacgcggcggcggcgaggggaatccggcgcggttggtcctgaccgcctttgaccagagccgtaacgccggtgaggctgaggaccaggacagccgctgagagtgcgtagcgcccccagcggttcccggccggcttcggggttccggtgtccgtcatgatcagctcaggcggcggcgggcgacgagggcgccggcggcgccgaacagggcgatgccgccgagcgcgtacagcgggatggagtcatggcgggtgctgccgtcaccggtggcgacgccgccgaccggaaccgagccgaccgccgcgccggagaccatgccgcacacggcggggtcggtcgcctcttccgggatgccgctgagaccggccgacttggcgagcgtggattcaccgaggccgtccatgtcgtacttgccgttcctgttcgcgtcgatcccgtgctcgacgacgtggaggtctttgaggtgttcgatcgtgcccgcaggcaggtcagcggccgggatcgtgcggtcgtaggacaggttgcccttggcgtcggcgaccggcatccgatcgacggccaggccgctcttggggctggtgtcccccttggtggtcagcgagatgaagatgttgccgtagtccggcatgccctcctcggtgctgacatagccgttgccgtcggagtcggcggacatgtccgggcagtggaagtccatgccctcggtggagccgtgcaggtgctgcgcgtgcggcgagttcgggaccagaccgatcgaccggatgctgatcttcaggtcgccgtcggccatggcggtcaggatggcggtgccggaggcgccggagtggttcaggggatcgagcttgacgtggacgctctcatcggcgaaagcggcgctcgggacggcgaggaggaccactgccgctgcgggcacagcgagcagggcgcggggaagtttcacaagggctccttgccgaggggaacgtgcacattcagtcacgatcgattcggagccgagaatcgctcggatgggtctggtgaagatcagtggcgtgggccggggatcgtccaggtgactgccggtcgcgccgagtcgcggaagccgtcagtgagggtgcgcaggatggatcggtcaagatcccagtcggcgtcccgggtggtccaggtcagcgcgtacgaacggtcgtcgccggcggccagcagcatccgataggtgtgcaggcgcggaccggtcgccggctgccaggaatactcccagtcggcgcctcccccagtgatcagaagcggtcccatgctgactctgcgatacccgggcggggctttgcgctccgcgtcttgccatcgttgcagcggtcggccgttgagcgggccggcggactgcacggtgaacgaccggtcaccatcggcatccctgaagcacacgtcaccgccggcggcaccgcgatgccagccgcgcggcaccgcgagagcgaagccatcggcgtcgacgtgccagagccaaccgtccggcagcgagaccggcgcgtcctcgccggaacccgtcaccggagacgactgcgctgtggagcaggcgtccatcgggctggcgacggcggctgccgcgggcggggtcccggtgccaccgccgtagatccggaccgccacggcggccaccagaatcacggcggccgtggcgatgccggcgacgagcagaccccgccagcgggccggcgccggcttcgccacaggttccgcgatcagggcggcgactgccggcgcggcggccgcgcggaatcggacgtcgctgtcggccgggcggcgcggtgccggcacggcgtggacaccgacggcccggcgggtcaggtcccgcaaagccgggcgggcgtcgcctgcggtcagccgtcgcttcggatcggcggtgagcaggccggcgatgacggtgtgcaggggccccgggtgctgcggcggatcaggaggttggtggagcagggccgccagcgactcggcgacctgcggccgggcgtacggcgctcggccctccaccgccatgtacagggtggcgcccagcgaccacaggtccgcctcccggctggagacaccgtcgcgtagccgttccggggcgatgtagtgcggcgagcccagcagcggctcggcccgaccggccgggacggcgacgatggtggccaggccgaagtcggtgagcacgacgcggccgtcctcggcgatcagcacgttgtgcggtttgacgtcgagatgcagcacgccggcgcggtgcgcggcgtccagcgcgtccaacagggtcgccccgatccgcgccgcgtgccggtgggtcagcgggccgtcgcgggtcacgatgtcgtgcagtgagcgggacggcacgtattccatgacgatccaggaccggccggccgcgcggaccacgtcgaagacccgaatgacgttgggatgatcgagacgggcagcggcccgtgcctcgcggacggtgttgcgcaggatctcggtccgatccatgtacggcagggcggccggcgccaagacctccttgaccgcaacctctcggtccagcaggtcgtcgtgggcccgccacacccgtcccattccccccgacccggccagggcgagaaggcggtaccggtcggccaccaccaggtcgccggcctgctgcccggcagcgccgtcctcttccggtcccacgccgtcaccatctccctgcacacgcatccgatacgcagggattcggcgccgaccggtcgagggattggtcgcgagctcacactccggcttctttccgcctgacgatgcggtatctcacccagtcggatgatatgtacctttcacggcgatctgcgggcttaacggcttcgaacccctgcgacagagccaccactgaggatggctcgtgcatcgagggggattcctcatgttcgacatcaatcgtcgccgatccgggcgggctggacgggcacggcgctgggctgttcccgtcgccgctgccgcggtgatcctggctgccggaggcggtctcgtcgccaaggccgccagcgccgccgaggccggcgggcgcgggccggacgagttcggcatgaccatgggcagccacgccggccactcgtcgggcttcacctaccaccacggcttctactgcgacacccacatcgccgcggcctcgaccaccggctgcgaggccggcgtcgcggccgaggtggcgccggccaggcacttcgatccgctgttcatcacggtgccgctgggcttcaccgtcaaggggctggactgcccggacaagctcacctgtgtcgatcacccgatgagcctggacatgacccggctggcgccggcgctcgatccggtctacaaggcgactccggagaagctgatgccggcgttgagagacttcaccacgccgggccatgaccacttcatcggcaccaggaacggcggcaaggccgagtggtgggacgtccgcgtggtcggcgtgaccgaccccgccacctaccgcgccatccggaagcaccagagctggacctacctcgacggccagatcaaggcgaagaacaagcacttggtcggcccgatcccgaccaacatgttcctgttcttcgccgcccactgaccgttgccccaccgtgcgccggggcttcagccccggcgcaccaccggtcaggaatcagatcagctcacggtgacgctgatggtgtgccagccggtcgcgccgtccggaaacggcgtagcccgatcctgcggttgcaccgcgcccttgctgtcggtggcgcgcaccgcgagcgagtgcggtcccggggtcgccttccaggtgaaccgccactgcacccacgtgtcgatcgaggcggtcgggagcagttcggcgggctgccaggggcctccgtcgacgctgacctcgacggcggcgataccgcggcgctgcgcccaggcgacgccggccacggtgaccggcccggccgtcatccgcgcgaacggcttcggcttgtcgatccgcgacgccgtcttcacggtgccctgcacgccccagccgcgtttgacccagtacgcgtcgaaccgatcgaaagtggtcagctcgatctcggtcacccacttgcaggcgcccgcgtagccgtacagcccgggggtaagcatccgtaccgggaagccgtgttcgagcggcagcggttccccgttcatgccgacggcgagcatggtgtcgcgcccgtccagggccgtggccaccggtgtgccgatcgtcatcccctcgtcggagcgggccacgatctggtccgcgccgctctgcacgccggcttcgcgcagcagggccgcaagcggcacgccgagccaccgggcggtcccgatgtagggcccgccgacctcgttggacacgcagttgagggtgatgtcgcgctcgatcagcggccgtcgcagcaactcggcgaaggacatctcgatctcccggtcgaccatcccgtggatccgcagcgaccacgtcgacgggtcgatgcgcggcacggtcagtgcggtgtcgacgcggtagaacgcggtgttccccgtcgtgaagtcgcggccgatcccacccggcagcggcttcgccgggtcggccgcggcgggaagccgaagggcctcccgggactgcccggccgcattctgccgctgaccggaaacggccagagcggagccctccacgacgctggcacccgccgcaagcagcgacaggcgaagaaccaaccgacgatcgacaccattttcccgtacgccggtgtccaccggccgtggcttgcgcaggagccaccacagcagcacgccggccaccgccgccccgacgaccgccgggaccgcgtccggcagggtcgctgtcggccgggacagtgccgcggccgccccgaccgcgccgagcagagcggtgccgaccgggatcgcggcccgccacctcgtcgccgcgatgccggtggccagcgccaggccggccaggacgacgccgatcacggcaagcagcaccggcttgtcgttggtgcccagttcccgtacggcgaattctttccatggcgtgggcgtcgcgtcgatgaccgctccaccgaccgcgaccaacggcccggccccgggccgggtcgcggccgccagaagttccgcgaccgcgaccccggagcccgccgcgacgatcccgctgatcgcgccgagcagggtgcgccgcatcagctcttcggcatcaggacggagtcgacgatgtagacgttggcgttggccgtctgcacgttgccgcagatcaccgacgccttaccggtgccgacggtgaagctctcgccgctgcccgcgacggtcaggtcctgtccctgcagcgtcttgtgggggccggcgaggtcggccggggtgagcttgccgctcacgacgtggtaggtgaggatgctggtcagcgtcttcttgtcggcgaggaccttgtccagggtcgccttcggaatcttggcgaaggcgtcgttggtcggcgcgaagacggtgatgccgtcggccgagttcagcgagtccaccaggccggctttcttcaccgcggcgaccagggtcgacagcagcgggttgccggaggccgcggtggccaccggcaccttgcccatcgcctcgaagctgcccgcgttcgccgggtcggtcggcaccgccgcgcagcccggaccgaagttaaccatgctggtccccatgctcggggccacgctggtcggcgcggtggtcgccatcggcgccgccgctgcggtgtctccgctgctgtcatcggagttactgccgcacgcggccagggagatcgcgaagaccgtcgtggcggccagggcagtgaacttcgttgcgcgcatgatgcgttcctctcatttcgggacctacacccctgattcggagcgaaccgcgcgccggattggtggaatctcaaattgttttcacgccggccacctgcagcgtcggcgcgggcgcgatatgccccaatggggcgacacgtagcgacactgcgcagcgctccacccgtctgcctcgttggacaaaacggacaaatcgcccttacagcgaaagcaggctaaagatgaagaaatctcttcgcgtagctaccacgctgggcgccatggcgctcggtctgggcgtcaccgcttctcccgcgttggctggtaagccgggcacgcccgaccacgccccttgccgccaaagcgccatgaacggctacggcaccaagcatcaccacaagcacccgaccaccaacggtggcgcagccgccgcgaacaacaacaccggctacggcgcgggcagcaagcaccaccacaagcacccgaccaccaacggcggcgcagccgccgcgaacaacaacaccggctacggcaccggcagcaagcaccacacgacgggcagtggcgcagccgccgcgaacaacaacaccggctacggcaccggcagcaagcaccaccacaagcacccggccaccaacggcggcgcagccgccgcgaacaacagcaccggcggttacaccggcgggcacgcggccggctagcacccgcagtacggccccgccagcgagccgttgtcgcaagaaccggacgaacgtcctcgggaaccaccgcttgatcaaaccgaacctcgttcggctgcgctcaagcggtgtttcacgggccagtgcaaacgctccgatgccatgtaccgtccccggcgccagattgggcccggcgccggggcaggagcagctgcgaagcacacctcaatgtcggatgcccctggcgctgcgctcttaactaccgctgccgaagccccgcaccgtctgttgagactctgtacgggcgtcaggcggtaagagagtcgttcggtgccggttggtgggtaggtagccggatggtgaaggtggtggcggcttcgtcgggttcgctgacggcgatggtgccaccgtgttcttcaacgatggtgcgggcgatggtgaggccgaggccggtgccgggcacaccaccgttgcgggcgctctcgccgcgaaagaacgtatcgaacagccggccacgttcctcgacggtcagcggcctgccggtgttcgacaccgataccgcgatggcgcgcgggtcagcacgcaggttgatgcctatggcgctgccccggggtgcccaggtcagcgcgttggacaacaactcgtcaaccacttgacgcagccgggcgggatcaccgtgcagcggcgcctgcggcggggtgttgacctcgatcgtgatctgagcgccggtgcgggcatcgtcggccgcttcgtgcacgatggtggccaggtccatgggttgccggtgcaggtcgacatgcccggaacgcataccggccacgtcgagcagtttcgtcacgatggcgcgcaggctcgcggtattgcgctgcatgaccttcagcatggactgccgctcgtcgacggacaggtccggttcgtcgatcatcacgtcggtatatgcctgcaggctcgtcaacggggtgcgtagttcatggccgaccagggcgatgtactcgtcgcggctgcgatccagctcctcggtcaggcgttcggcgcggcgtcgggagaggaattctccgatgtgcgccccgataccggtcatcatggcggtacgggtatcgtccggggtctcggggacgtcgctgtagcagaccaacacgccgaggatgacggatccgctggggatggggatggccagggcggcgcgcaacggcccccagtcagtggcctgctgggcggcgtcggggtcggtgggcaggttcgccgcccagatcgggtccgacgtctgccacgcgcggcccggtacaccctggccgtatgacaatgggtccggcaatcggcagggcaggtcgtagccgggttcggcccaacaggtggtgcggtacagcacccgggcgacatcgtcgacggtccagaattccaccgccgcccacccggccatccggctgatgagctgcaccatctcggcgaagatttcatccggcggggcgggcttggaggtcagccgggagagctccagctcgcactccttgaagcgggcggcgcggcggtgcagcgtaatctcgtgcaacgccactaccgccgctagccgcggatgaccggcgaccgggcggccgttggcccggaagtaccggcgtggcgcttcggggactcgcactacgatctccgcgtcacgtacccgttccccgcgcagggcgcgcatcagcggaatgtcatcaccgctcatccgatgtccgtcggggtgaaacacgtgttggtactcggcccaccgctggaccggcacctgatccagcagggcgccgaaaagctggcgggccgcttcgttgcgtagcacagttcggccttcagcgtcgcagccgaccacggcggtgtccaagctgtcgagcagggcgtgcaggctttcgttctgttcctccagttcccgccgggcgaagacttccgtggccatctgctcggtacggatccgcagttgctcggtgagctccgccagcgcggccggatcgttgtgacgagcctgcatgaacgcggtgacgtcctcggtacggtgaatgatccagcgcagttcgccgtccggaccgaacaccggcgcgttggcgggcgcccagtagcgggtgtcgaaaccaccccacgggcgagggatgtcgtacctctggatcgccatgacgtcggtggtgcactgactcaggacccgctgcaacgacgcgccccacatcgtcacgccgcttgccgccgcgtcctcgggattgtcgggaaacgcctcgaacaccggccggccgaccagctcggtacggctgcgcatggtggccgtcaggtacgcctgattcgcctcgacgatcatcaagtcggtgtccagcaccagcaacggtgtgggtacggcccggaacagcgcctcccagctcacttcgttcaccggctcagccacgtcgccccctcccgcagccctctaggacagagtacgcaaaacgggcgacaggtgtcgacgtataccgaccttgctcaccgcctccgaccgcaatccgcaccggagttgccatacgtcgcgtgatcgattctggccaaagcggtgatcccgcccccaccctcaccacactcggcaagatcggctgcggccctgcccggggctaccacctcgcccagcaggctgtcacagcggcacaagggctgaacacggatgtctttgaaaacccgttttcgggggatgcagatcagcgtcacttgtccactggcccaggcgcgatgatgactggggatgttgctgacctggcgggaggccgcgtcatgattccggtacgggcgatagccgaccaagcacagaccgcggcgttggcgcgttaccacctcttcgacggtccgccggagcccgacttacagacggttgtggagttggctgcccagctgtgccaggtcccgatctcggtgctgttcgtcatcgacgccgacagtcagcaccaggtcgccgccgtcggcatcgacacggaagtgtgccggcgcgaagactccatgtgctcggtcgcgatggccgctcctgacccgatgttcatcgaagatgcacgcaccgacccgcgcttcgtagccaaccccttcgtaactggcagatttcagcggtttcgcttctacggctccacccagctccgccccccggaggggtttgtgctgggcaccctctgcgtgttcgatgaagtcccccgcgtgctcgatgaacagcaacgacaaggcctggaccggctcgctcggatggccatcgatgtgctcgaactacgcagacacgggtttctcgtcgcggacctgctccgccggcaacaacaaatccaagccgcgctggagggcaccaacgaaacgctgcggcacttcgctgcccaacttgcacatgacctgcgcaacccgttgaccggtatcagtgcctacgccgccgaactgcacctcatgcctaccgtcaacgccgacgccgacgcctccttgtgcaccgaccgcatctccgccgccgcgctgcggatgggcactctcatcgacgacgtgctcgcccacgccacgaccgaccacgcccgccacgccgtcgaggtgaacctcaccgagatcaccaacgaggtgctcgatgaccttgccgtacagatcagcgaagcgaacgccgacgtaaccgtgaacgaccttcccaccgtgatcggcgaccgcacccaatggcacatcctgctgcagaacctcgtcagcaacgccgtcaaataccgccacgccgagcgggcctgccacatcgccatcaccgccgccgacgaccctgccgggtatcgcgtctgcgtcactgacaacggcatcggtatccccgccagtcaacgtgaacaggccgctcaacccttcacccgtctcagccccggccacagcaccggtcacgggatcggtttgtcgacctgcgcccgtatcgtgcacacccacggcggcaggctcgacatcagcgacacccccggcggcggcaccaccgtctgtatcaccatgcccacagacaaccgttgactgtccgagatgttggccgggccctcgcagccggtaggggtgtggccggacataacccgaaacagctcgggatggccacggcccacttccagccggaactcgtacagcccggtctcctggtctcggccgatcgcatcggtatcggacatgatccgcacctcggctctcggtaagggcctccgggtgggctgcggtcgccgcgttagagcgggctacggcggggtacagggtcaagctgatggcagtcggtcccagaacgctgccagggtagccgcgccggagagcagcacatcgatcgagacgcgctcgttgctgtcgtgccagcgatcctccggtagcccggtgccgaagtacaccaccggcgcaccgacgctctgcgtgagccataccgccggaccgccaccggcgttgcccatccggcccgccggacgcccgaatccctcctgcatggcctccgccagcgcggccaccgccggcagatcgtccggtgtgcggtagggatcctgtgcggtctccggggacacggtcagccgatggtcgaaccgctcgctcacagtatcggcgacccaccgtcgcaactgctcggcgatctcggcaccggtctggtcacagacgtaccggatgctcagatcagcggtggccagcgacggcaccgccgcccgcgacggcccgatcggatcaccactgatcatgctggtcacctcgatcgccggccgcgtccacagacgttccagcaccgtgtacccggcctcaccacccacgctgcgcgtcagggaccgcttcagccagtcggcgtcgctgtacggcaacgcggccagctcgtcgcgaaaccgctgcgacggctccaccacactgtcgtagaagccgggcaccgtgatccggcccttgtcgtcgtgcagttgggcgagcagccggctcatctccaggaccgggttgggcgccggcccggacaccgctccgctatgcacgtcctgcaacggccccatgatctcgagcttcgccagcatcgtgccgcgcatgctcacgcacacggccggatgatccgaccgccacagcagcgtgtcggagaagacgatcagatcggcgccgacccggtcgccgttatcctgcagaagctgcctcagatgcgctgacccggtctcctcctcaccctccaccaacagcttcagattcacggcgggatggtcgcggccggtcgcggccaggtgggcacggacaccccacaggtgcgcaagagcctggcccttggcgtccgacgcgccacgcccgtagaggtacccgtcacggaccttcgggtcgaacggcgcggtctcgtcccactcctcgtccttcgcggcacgtacgtcatggtggctgtagatcagaaccgtgggagcgcccggctccgcgcaccactgcgcgtacaccgccggaccgccctcggtgtcccacacctccaccgacggaaaacccgtctcacgcaacgccgccgccagccaattcgccgaccgctgcaaatccaccgcatgctccggaaccccggcgaccgacggaatccgcacccactccgccagttcggcaaccacggcgtcccgatgctgcgccagaaaaccccgcacattcgtgctcactgggtgatgcccccatctgcccgcccgggccactgcgcctaccggccacgattcgcctgccgtccatgccggactacccccgaacagagcccctatgcacaacggggacgctcatcagaaccccgcctggccgggccgccgtccggcacatcacctggccaagcagtcctaccgccgacaacctgagacaaccaccgccaatttccgcaccccgccaacaagcgcgagctcgccaccgctgccagccgctccaccgaaggcacccggcaggtagccgacgcggtcaccgcactcgcgcggatcgccacccacctgagcgacctgacgagcgtttacgacgcagtggaggtcacccgcatcggcgcctcctcgtacgcatcgccggctacccgcccgtacgcccgcccagccagcgtgccggcgcggatgcgggcgaccaggtgcggtgcgtcgaccgcccgccagcgttgctgtgcggcctcgatcagcttgaacgccattgcccaaacacaccggccatctgggccagcgccgcagccgggctggtcgccgtcgccattcagcgctcgatcatgagccggcaccgtcctggcacctgaccggtgccttcccggtggtgaggcacagcctcgattaccaacaaagtacctaacagaccggaatgaatccaagcaggagcgggctttcagcggcaacggattacacccgcagcgagtcgcagcccgcaaagggataaaacacaccgcaggatgggtagtgggatgtccgagtagcacaggcacggcggcggtggtcgcgagcgccgtgatgatccgaccgcgcgtcagcgggggccggcaaggtcaccccgactgaccacgagaactggagcaggctgatgaaggtattcaagctggccgtcggattcgccgccgggtacgtcctcggcacccgcgcgggccgcgagaagttcgaacagatcgccgcggcgacccgcaaggcgagcaaccacccagcggtgattcaggcgcaggacaaggcgaaggcgatgctggccaccggccgagattccatcatggcgaagctcccgcacgacgacacggccacggcgagcacgccgtcgacgacctacccgacgcagacgaccgcgaccaccgctgctgtcggcacgccgagccggccacgcccctcgaaggcggcccacaccccgtcgcccgtcggcggtgacccgctgccgtagttcgcgtgttcgtgacggggtgggcgccgatcggcgcccaccccgcatggtcggcatcgtgatgacgaaccggcatggggtcaacccgattgccgccagctgaatggctcggtatcggcggtggcgaggggcggctcatcgtcgctgaccacgagactcgatgtgacgacgaacggccccttcgccgttcccggcataggcagccagaaggtgaagctcgcggtgtcatggtcgctggtggccttgagtgccggctcgagcaatctgttgctccagccgacggacagcttttcctgtgggttccggctggacatggaccaatacaggcgcacgatgacgccgcgtaggctgtagaggctgatggtcgcgcggacctccacgccgatctcgtcttcttgtgtggcggaccggttcggggtgcgggcgggtttctgtttcctcacgcgcgtttggcctgaacgatgcaggggttcaaccgcgtcgagttgtcgccggtatgcctcccgcgctgacagccgttcaggacccttctcccccggccgcgcgggtacccattccacgcctccgggcggcacggtcggttgcgccggggacgtccgcgtcgggccggggaaagtgcttgcgcggtcgtccggcctggggctcggcgaccgggtcgcctcgccggggacggtactcgtgtcatcgacgcgtccggggtccgaagacggcgacggcgatgtcgtggcggcatccggagattcggtgaacgccgcctccatcatcaacgcggcgggcaactgccgcagaccgaaggctccggcgtgcgggagcacgatgagaggacggtagtcgcgtttcagcatttccctggtgacctgcaggtgcaactccgcagcgtgttccttggcatcgggaaagacgacggccacgacggcggcgacggcgccgacgagagcacccgcgccgagcactgcggcatacgcccttttcggccagcgccagcggtccggtgcgggagagggcgtcgacaacttcggcaccgcggctcgacctcgggccggcgcaaaggtggtctcggagtcagaggtggtcatcgcagttggcccgtcagctggcaagctaccgaattaggatgaaagcataataaatctcacatcatggcaggtctgacgatcggctgaatccgaccagctcacgcaagaggcggaccagagccgacacgtcactcaggaagggcgcctcttcatccatctgatacgcaactggccatctccgtgggtccggacaccgtttcaacggctgtttcgacaccgcatgatcagcggtagatcgcgtatccgtgagtttcggcaccactgttgtgacagctaaatctcccggtgggccgccgagaacgcgctcgtcgatgacccggcacacgcggctcacctactgcgggctctgcgtccggcaggtgcggacgaccaggcgcggcacctggccggccgcgtcgtcgccagagtccaggcgcagctcgaacgggtcgcccgatctggaccccgaggtcaccttacccaggcatgcggtgcggatggcaggtcgtcggcaccaggcggagcaatcggctgatggcgctacgccgggtaggggatgctggaggcatctgcggttcggagtgcgcacgggtccgagccatgtcgtcctgaagccggaggctgtggcggtgcgcctgtctcgtcgtcgcgccgatgctttgttggagcgtcgcctcgaggatcacatggtcacggaccaccttctggttctcgtgttcacggtgatgatcttggtggctgccacatcgatggcacttcatccggacgccggccggttgaaccgcctcatcgaatctgtggctctgggggccaggacgctggccgtgatctggcttgtcgcgacccgaggccgggcacggcatccgtggaccatagcgacgctgctgctcgtggacatcactctgctcgcggccgtgttcgcgacgatcccgattccgtacgcccgggagccgttcgtcctgcactctgtgatgcggttgccgctggtctgtgccgctctgcgacggcggcagatgatggtggtgctgcccgctctgctggccgggccaagcgtcattctgggctggcagatgttcacgctgggccggaacggcatcaccatgccgctgctgtggctggtgacggtcggggtgaccggctactgcatgcggcggctggctcagcacctcgccaccgcgcgagccgaggcgctggagctggccgcacgccggcagcacgatgccctgcatgactcgctgacaggtctgcccaatcgcttcctctacgctgaccagctggccgaagcagtcactgccgcggctccggacggcccggacgtggcggtggtgctcatcgacctggaccgcttcaagatggtcaatgacagtcatggtcaccagttcggtgacgaagtgctcgtcgccgtcagccggcggctgcgtcacagcctgcgctccggggacaccctggcccgcctgggcggggacgagttcgccgtaatcctccgggacatccacgagccggccgatgccttggccgccgccgcccacctgggtgccgcgctccgggacccgctgcaccccggcggcgccggcgcgtcccccgggaccgggccggggatgtacgtcacggccagcatgggcatcgctttcgcccgccggcacagagacgacctcggagcggtgctgcgcgaggccgacatcgccatgtaccaggccaaggcgcggggtcaagcgtcggtggaaatcttcgacgagacgatgggccgggtcgctcatcgtcgcctggacctggagaaccagctgcgccacgacgtcgaaaccggctcggacaccctgtcggtggcgtttcagccgatcgtggaaccagccggcgggcgcatcgtgggtatggaggctttggcgagatggagttctccccggtacggggcggtacccccggacgagttcatcgccatcgcggaagagtgtgacatcatccacgacctggggcgccgggtactgcgcaccgccctcgaccacaccctttggtggtgcacactgcagcccactctggagatctcggtcaacgtctcgcccgtacagctgcaccgccccgagttcgcggacgaggtgcgggcgctgctgcgacagacccgcgtaccggcggagcaagtgtgcctggagatcaccgaaggggtgctgctcgacccctacggagcgagcgacgcgaacctgcgtgccctgcacgaagccggtctcaaactggctgtcgacgacttcggcagcggctactcgtcgctggcccagttacgccgattcccggtcgacaagctgaaggcggacaggtccttcatcgacgacgccccgctcctgcaagccgtcgccgacctggccctcgccttgaacgcccaggccctcgccgaaggtgttgaaacgcccgagcagcgccggcgcctcgtcgaactcggttatgcgcaggctcaaggctacttcttcgcccgtccacaaccgccggccgccgtcaccgaactgctgcgctcccagcagaaccagcagcaaggttcgtctggccgtacctgacgacacttcgacccggtcccgtcaggctcattgcagggtggtgggcggctcgccgggcagatcgacgtcgattttctccttgcggacctgtccggagacgatgtgttcgtcggtgtggacgatcttcgtcaggcgtacgcgttgcaccggcacgatctcggtggtgatcacggggcgttcctcgtgcagggtgacttcgaagatcagtccgccgtcggggccggtgaagacctcgtcgggtccgaacacgtcggggtccgccactacccgctgatcgggcgcggcgatggcttcctgttccaggcggagttcttcgcggcggatctgcacggtgatctgcacgtcttcggtgaccacgtatttgcggagccgcgcccgtccggtctcgtagacctgggtgctggggacgagccgttcctcggaccgggtcatggcgtcgtcggtgttctgcagcgcggcgatcaagtcagcgcgcggcatgccggtgggtgcggtgacgccggcggtggcagcacgctgccgcaactcgacgtcggtcagcgcctctggatcggtgttgttcatcgtgcctccgtcagggtcgaagcgtcaccgaggccggtgagcggagtcggttgcatgcggtctgcggcccgtgagccttcgggtatgtccatggatgtggtcgtgcccggcgccgacccatccggcgccgggcacgaccaggacatcgtgatcagaggcggttggtgccgtcgggaccgtcgtactcgatctgctccttgcgaacctcgccggagacggtttcttcgtcgcggacggtttccttgctcaggcgtacccgctcgaccggcaccgtctcggtattggtgacgggtcgctccgcgtgcagggtgacctcgtgctcggcttcggtgatggccggcccgtcgtaggcgtcaccgatgttcgcgtcggtgatcggctcgcgctcgaggcgggcctcctcgtgggtgacggggacggtgacctgctgctgctcggtgaccacgtacttgcgcagccgggccttgccggcctgctcggtgcgggtgtcggtgaccagccgctcctcggagcgcgtcatcgcgtcgtcgccggcatggtcggtggtggcacggcgccgggcgccgctctggtaggtgtcgtcgttctggtatccgtcgccgtagccgccggtgctcggcaggccgtagaaggagtacagctcgttctcctcggcgtgcgagatgggcccgtcggcgtcgatgcggggagcgtccttgacctgggccttggtgtaggcgacgacgacccggtcgtcggcgaaggtggcgtcgcgcagcgggacgaaggtctgcttggtgccgaacaggccggtcttgacggtgacccactccgggtcgccgctgcggccgtcgaggtagacctggccgacggagccgatcttgtcgccggtggtgtcgtacacgtcggtgtcgtcgagtcgagcgatgtcgttctgggtgatcacgacaggtccttccggggggaatcaggatcgaggtcacgatcgcagtgcgcagtcgtcgattccggacccgtgcaagttgctgttttcacgggtatcggatgactactcggatcgcttgatgactcaaagatgcccagcggtttaggacataaacgggatacgcccggtcggctttcagccggatggggtcttcacatgttctcggtcagtcgtggtggccggcggcgacgcggcaacagcagcgccacacggtcgaggagggcttcgagggcctcttcgaagtcttccgcggcggcgtcgacggacaggtgcggctgcaggcgctgcaccatggggtactcgctcaggtcctcgatcggtgacacgtcgggttcctcgaccggtccggtctccacgcccctggccgacacctcgagcagcaggtagccgaggaggaagctgctgaacgcccggtagaccgcggcggcgttctcgtcggagaagccggcctcggtcatcacctcgagcagcgactcgatccaccgcagactgcgcagcggaggccggacccatggtgcggcggccggccgggtggcgaccagagggaagacctcggggtgggcgagcgcgatgcgccgcagcccgtgggccaggcgttgcaggtagtcgacccagccgccctgggcctgcaggtgcacgtcggggtcgccgtacaactcgtcgacgacggtttcgaccaccccgtccagcagcgcctcacgcccgggcacgtaccggtacagggccatggcttccacaccgaggtaggcgccgaggcgttgcatggtcagcctgcgcaggccgttctcgtcgatgaactgcactgccgcgctcaggatgcggtgctggtccaacccgctgcgtccggttacgggatggcctgcggcgatggcagggtcgccagcggtcggcggcgtgtccggatcccgtgtcatcgcgcctccccagctggtgcgcccgcttcgcataccgcgcaagcctctcatagacgaaacccggtcgccgacagggacgggtcgggcacccgggcgctgaggtgacgaatgaccgattgccgagttgcgaatcagattcactttgtcgtttacggcataaacgacgaccggtgcacgaatcgccgggatgcggttgaaaagccgggcggtggggattggagccatcgcagattcgcctatgcaggaggcatgacatgagcgctgaccaccatcgcgaccgtcgcgacgcggtcgcgaccacccggaccggcgacgacaagccgtacgacttgtccgcgcccccaccggacgccggcccggacagccctgtcgagttgcggggcaaggggctggtcggcgcgctcaagcgcaccggcaagcagttctcgcaggacaacctgtcggactgggccgccgccctgacgtactacggcgtgctgtcgatctttcctggcctgctggtgatcgtgtcgctgttgggcatgctcaacagcaacggccagaagacggtccaggacgcggtgcaccagctggcgccgaacccgcaactgcaggacatggtcaacacggtcctgacccaggtgcaggatcccggcaaggccggcctcgccgcgatcatcggcgtcctggtggcattctggtcggcctccggctacacggcggcgttcatgcgcgcgtccaacgccgtctacgacgtcccggagggccggccgatctggaagaccctgccgatccgggtcggtgtcaccgccgtggtcgggatcatgctcgtcgtctccgcggccatcgtcatcttcaccggcgacctcgcccggatcgtcggcgacaagatcggcctcgggtccgccgcggtggcgacgtggaacatcgcgaagtggccggtcctgctggtcctgatcagcctgatgttcgcgatcctgtactgggcgtcgccgaacgccaagaccggctcattccggtgggtcagtcccggcggcctgttcgccgtactgctgtggatcctcgcctccgtcgcgttcgccctctacctggcgaacttcgcgaactacaacaagacctacggcaccctcggcggggtgatcgcgttcttggtctggatgtggatcagcaacatcgcgatcctgctgggcgcggaactcgacgccgagctgcagcgcggtcgggccatcgccgccggccacgacccggccgacgagccgttcctggagctgcgcgacgaccggaagatcaaaccgggcagtgagcagggcctgagcaccaactgacacggcacgaccacctcgatcccaagaacgccggcctccgggtcgcgcaaccgccgactcggcgatgaaggagtgaaaaacgtgtccgaacgaatagcacagggatcagcagcgtcgaccggtgatctggtcagtcaggcagctgcgcagatctcgacgctcgtccgcgacgagctcgcgctggcaaagctggaactgaccgagaagggcaagcgggccgggatcggcggcggcctgttcggcggtgccgcggtgctcggactgtacgggctcggtctgctggtggctctcgcggtggtgctgctcgacctggtgtggccgctgtggctggctctgctggtggtgctggtcgttgtgctggccgccgccggtatcgctgccctgctgggcagaaacaagctgaaggacgccgtgccgccggtgccgagcgacgcggtggccagcgctcaagccgatgtgcgcgcggtgaagaacgccgtacaggaaggaaaatctcgatgagccagtcccccacaccgaccgacccgcaggagctacgcgcggaaatcgaacggacccgcgccgagctcgggcagacggtggagcagctcgcggccaaggcggatgtgaagacccgcgccaagcaggcggtcgcggacgcggctgggcaagcgcaacacaagctcgccggcgccaaggaccaggccgtacaggcggccggcctggtgaagggcaaggcgttgaccgccaagcagcagctggccgattccgacctgcccgcaccgatgcgccgaccggtgccgctggccgccatcgtggcagccgcggccgccctgatcatcacggtagtcgtcgtcgtccgccggaggagctcatgagcagcaagacactgaagatcgcgtacaagccggtcggattgctgctcggcgccggtgccggggctgtctccgggctgatcttcaagcaggtgtggaagctcatcgcgcatgacgatgacgcacctgacgccaccgaccaggaccgcggctggaccgaggtcctggtcgccgccgcgatccagggagccatcttcgccgtcgtcaaggccgccgtcgaccgcgccggcgccaccggcgtacagaaggccaccggacagtggccggactgagcactcgccaggcagcgacacccgtcaaccatcgataggagctggacagatcgtgaaggtgttcaagttcgcgaccgggatggcactcggctatgtcctcggcagccgtgccggccgcgagaagtatgaacagatcgtcgccgccgcccgcaaagcccgaacccaccccaccgtcacacaggcgcagcaaaaggccaaggacctgctccacgcggcgagcgtcgagtcagccgccggcaccgatgcacagccgacgcaggtcacctcgccggccaagctcaccgcctcggcgactccggcggcgcgtcccacccgccgcaagcccaccaagatctcggccgtctccactacggggacggatccgctagcgtgaccgcagtgacgaactcgggtctggctacggctgggcccgagtccggcgttccaacatcacaaggtcgcctggcggatcaattcatggccgacgaggttgaggcagtcgtcctcggtgcggctgagccgtcgacgtcggtcagcggccggacctcggctacctccacacctcacacatcggccaagctcagccatggcttcagtcttccggcaccggaacatccgggaccggaagtactcaaaccaatgcgagctgttccagcagcttcccattcgtccggcggcaatcagcactgcgtcggcaaccgattggcactcagcgttgggtggtgacaggccgaagggaaaacgacgcggccggggtatcgctccggttgcgcacaatgcgcgggcgtcagggaaggagcttcggatgccttggttcggtcgtcgtcgacagcagacaccggaggcacgcccggtcccccgcgatgtcgaagcgctggaacgggtcatcgaggcgctcgcgggcggcgcggcgtccgtgcaagacggccgggccaagatcactagcaccctcgttcaggtactcggtctggattatggggcgctctggagctgtaacgagcgcggcgactacacgctcaccttcgaaaccgggtccctcggcccggccctgcgcggggccatcggcgggacagacaccctcacctcggcggacggcctgatcggcgcagccgtcaccggccggcaagcgatcaccctgagcgagacgccacaggccggcagctcctgcctgcgctggcaggccgcccaccgggccggcatggtcgaagctgccagcatcccgatcgtgcacgacggcacggtcgccggggtcctcgagttctacggccggcagccgctgcccgcgttcgccagcgacaaatgggccgcgatcacccgcatcgccgtactcaccggcctgcacgccgcggcggcttccgagctcaaagagaccctcagcgaccgggccgcggtcacgaacgtcgtcgccgaagtcggcgaagcactcgaccagcagtccgccatccggatcgcgctcgaccgggtccgcaccgcattcggatgggcatacggctcctactgggcgctcgacgaagccgaccaggtactgcgcttcacctgcgagtccggttcggcgggcgatgagttccgcaaggtcaccctggcggcgtcgttcgccgaaggtgtcggtctgtcgggacgggcatggcgggccaaggatctggtattcgttcacgacttggccgagatgaccgactgtgtccgggcgcccgcggcgcagcgggcgggtgtgcgctcgggagtgtgtttcccgatcatggatggtcggaccgtcatcggaacgatggacttcttcaccaccgagagcatcgaactcagcgactcccgggccgccgcgctgcgcaatgtgcaacagttggtgtcccagcggatgtcggcgctgcgccgggtggaaaacgacgccgcgaaggcacgccaactgctcgatacggtctccgagctgcgcgccgcctccgaggacgccagccgcgtcgccgctctggccgcgagcggatcccaggcgatgacgacagaagtgcaggcactctcccacgcttccgcggcggtcggtgacgtcatcaaaatcatctcctcgatcgccgagcagacgaacctcctcgcgctcaacgcgacaatcgaggccgcacgcgccggcgaagtcggcaagggcttcgccgtcgtcgccagcgaggtcaaagacctcgcccgggagacagccgaagccacacagaaagtcaccgagcagatcgccggcatccagaactccagccgcgcagtcgccgagggcatccatacctccagcgacaccatcgggcagctcgacatcgtgcaagcccggatgaaccaggtgctgcaacggcaggccgacatggcgtccgccttccggtcgtgatcgccggtccggcagggcaggcagatgcacctgccagcgacgcgtacaccttcgcgggtcccgtccacctgcggcgccaccacacctgtcaccatctcagccgtacgcaacatcagcctgaagaagacgggctacacacccgcacccacggtgttcccataatccgtcaaaggccccagaaagaagttcaatgagcagcatgccgccgcgccacccagtgacgatcaccatgggtggcatcgacgatgggaccgtgcacctcaccgtggccggtgagatcgatctggccaccgccgatgttgtctacgacgcgatcgccgcggctgcggacactccggcagcacagcacgtggaaatcaatcttcgacacgttgaattctgcgactcgactggtatcggagccctcatgagggccagacacttcgcgctcgagcacgccgtcaccctgcacgtagtggaacccagcggcttcgttcgccgcgtactggaactagccggggtcctggagatactcaccgaaccgaaatagcgttgtccccatcgcgtcgacctggcgacatagggaattcgtcttttcgtcggcggcaacctccaggacgcaggcaccacggttgaagccggaccacacccgcgagcagtcgcagtcgtcccagcgacgaattcgcattggcctggctatccacgtcaacgattgggcaggcgacaacaaacgcgtagcgacccagctgctgccgccggattccccgtcccgggcgtgtcgccagcccgtgagatcctcacgcacggtgacgggcacgccaggcgagacgcgccttgtcggcggcggatccggatacctagcaggcggtcttatcggtcgcgccctcctttcctcgatgacgggcccggcgtacgggtcgcgtgcaggcgttgctgcgcgagggcgagccagtccggcgtgccgtaggcggcgacaaggtcccgtcggccgggtcgccctggttcgacggcgtggggtatgccgatagcggccaggtagtcatggtccaccacgacaaattggcggcggtacggcaacagcaccagcttgtcggtatccgcgaggaacacctgcgcctgtgaatagctgggaaaccagtggctgagcagtccggtgcaccgcggcgcatgccagaacgtgcccaggtcatcgccgatctgcgcgtcgccgccgagtacccgccgggcgtggtcccagccggcgaagccgacgttcttggcgaccagagtcagacagtgccgtaaacgccagccgggcgccggtgacgggccccgtcccccgtcggccggcaagtggccgagaaggccgaagtctccccggcgggcggcgttgaggcagaggcgcgcgcggatcttgagttcggcgaccagaacgttcatgccggtgtcccgaagtcggcgaacggcgtgccggcgctgaccacagcacggtggcgcgcctcggtccagcccatggtctccggatgggtgaaccagtagaacggtgcaccgctgtcgaggccgtggagaactcggcgggcaaacgcgtcggccggctcagcatcgcgcatcgcggttctcatgaagctctcgaacgcgttgggctcggtaggtgcggcatgggcaacctcggcgtagcggttcacgtcggtgatgccggtacgtacgagaccggggcacagtgcgtgaacaccgacaccatcgctgagtgcctcgtagtagaggccttccagcgcgctgagcaaggcagccttggtcgcacggtacggacccgcgcccgggtagctctgcaaggccgccgctgacacggtgactaccgccttgccgcggccggcgaccagctgtggccaccacaggcgaagggaacggatgacgctgagcacgttgacgtcccaggcccattgccacgcctgctccggtgaggacagcacatcgccggagacgccgacgcccgcgttcgcgaacaggtagtgcaccggtcgcgtcgacagcgactctgccagcctctgcatagcggccccgtcgcggacgtcgaactcgtacgcctggacgcgctcgtcgaggcggctggtgtcgcggtcgatggccactacctcgaggccacgggcgagcagggcctgcgtgagggcgtagccgatgccggaaccggcgccggtgaccacggcgaggggcgacagagaagacatgacaactccaatgcgtttctgtggccacccgcgttggccggaaacgactcattggatcgccaaggagacgatgagttacgtcatgagggtgagagcctcttgcgcgggcaggcacccctcagcacctgaggcgatcactgtagccgacgtcccccaccgcggtcgatcggcttccgacgaacgcgtttgccagcccctcgacgcacggctcccggcagaagcgcgcgtcgccgctgtgagtcagtgagggaggcggacgtgcacgctcgtacccctggcctggggggcgttggtggtgacggtgatggtgccgtcgtggcgttcggtgatcagtcgtgcgatggtcaggccgagtccggcgccgggtatcgcgagttcggtggctagagctcctcgaaagaagcgctcgaatacgtggggctgttcataggcgggtataccgaatccggtgtcggagacggtgagctcgtcagcctggctggtgctggtcagcgtgacggtgacggtgccgccggcaggggtgtaggcgatcgcgttgtcgagtagggcgaggatcagctggcgcatccggtggtagtcggcgtgctgcggggtgtgtggtggcacgtggcaggtgatcgtgatgttccttttcgcggcgcgctcggtgacgtggtcgacggcggcggtgacgacggtgctgaggtcgatgtcgctcatctgtagtgggctgcggccggcgtcgagcgcggagaggtccagcagtgcggtgatcagccgccggagacgttcgctcccacgccgggctgcctcgatcatcggtaccaggtccgctggtgctgtgtcgtggacgctgtcgtgcagcagatccagatacgagtcgatgatcgccacaggggtgcgcagttcatggccgacgaggttgaggtagtcgtccttggtgcggctgagcatttgttgcagccgttcagcgtggcgggcggcggtgatgtcgtggaacaccgcgaccgccccgagctgctgatcgccgtaggtgatgggatgaccgttgacccggaacaggtggcgttgcccctgaacctggaggaagttctcggcgccacgcaccgtttcaccacgcaaggcacgcagcagcgacgtgcggtccgggctcagcggtgtgccggtggtgtcggtagccggcaggcgggcaacccattcttcggctgtgccgtcgacatcggtcagctcgaggcgctcccgcagggaccggttgaccagcacgaggcgaccgtccgcgtcgcaggcggccacaccggtgtcaaggctgtcgagcagggtgtccaggaagactctctggcgcagttcactttcgcgggcgaggtgctctgccaccagcgcggtgcacgcctgcgcgccctcgtcagctccggccagctgctcggggagccagtctcgcgcaagttcgtcggctacagcgcacaccccgacgatatgtccgtccgggtcgcgtaccgggaatccggcgtagcagcgaaggcgcgtggagcgcaccggcgcgtccagcggaacacggatgtcggtgtggatgtcgttgatcgtgaccgggaagccggtgtgcaggacgaggccggcaagggtggaggtcaccggcacgggcttccggttgtcgaagccggccggaatcgcctgtccgccgatgaggcgtagattctgcccatcggtgatgtggatcatcgcgcaccgtgcttgggcggcgcgagcggtgaccgcggccatccggtcggcggcggtctgtgtcatctgcccgcgggtcagttccaacgcggccgccgcgccggtaccaggggctactgccgtgctggtcccacggttcggctcccaccgtagtcccacacctcatcatggcctactgggccgcgacggcgcggcggttcggcaatgtgaggccacgtctacccggacctggaggtgatcgtcgtcgacgacggctccagcgacgacaccgccgccatcgtcgagcggctcgggcttgcgcgcgtccgggtcatccggcagcccaacgcggtaaagcccgccgcgctcaacaccggcatccggcactcccggggacagatcctggtgctggtcgacggcgacacggtgttcgcgccggacgcggtaggccggctcatccagccgctcaccgttcctggcgtcggcgcggtgtccggcaacaccaaggtggcgaaccggaccgggctgctcggccgctggcagcacctggagtacgtgatcggtttcaatctcgatcgccggatgttcgatggctatgacggttgtatttggctccaccagggcggcttgaactggccccacccgcgggggactttcccgcacggatgggcgacgacggcttgaagtggccccacctgcggtgttgcgcttgaagtcctgagtgtgctcgccgtctgcgggagccgccgatgccgttgaccaaggacgaactgttccgccggatccgttccgatgcggtgctcgaggagctgtcgattcgggcgcttgcgcgtaagcacggtgtgcatcgccgtctggtccgcgaagcgctgacttctgcggagccgacgccgcgccggcaaccggttcgccgttcgccgcggcttgacccggtgaagaagacgatcgacgagtggctgcgggcggatctggaagcaccgcgaaagcagcggcacacggctcgccggatcaaggaccggctcgcggaagaggcggacactgacgtcccgtattcgacggtgcgtgactatgtgtcgatgcgccgccggcagatcgcggcggaggcgggtgctccgatggacgggttcatcatccggcacaaccggcccggcgccgacgcggaagtcgacttcggtgaggtcgtggtctgcctggccgggacaatgactcgctgtcacctgttcgcgttccggttggcctactccggtctggcagtgcaccgcgtgacggtgtcctgcggacaagaagcgttcctggaaggtcacgaatacgccttcgagttgatcggcgggatcccggtcggtcagatccgttacgacaacctgagttcggcagtacgccgcgtggtcttccgcagccgatcgagggtcgaaaatccgaggtgggaggctttccgggagcactacggatttacggccttctactgcattcccgggctggagggcgcccatgagaagggcggggtcgagggccaggttggctactaccgccgcaaccggctgaccccggttcccgtcgttgccacgttggaggatctgaaccagcggctggcggctgctgatctgaccgaccgggaacgcaagatccgactccggtcgagaactgtcggtgaggacttcgccgccgaggctgcgctgctgggccgactaccgaccgagaagttcggggcgtcactcacgctgcggcctcgagtcgatcgcgaggcgacggtgacggtccggatgaacgactattcggtcccggcccgcttcatcggccgcaagctgcaagtcttgctcggcaccaccgaggtcgtcgtctccgacggccggaccgaggtcgcccggcatccccgcctgcccggacgcggcggacagcacctgctgctggatcactatctggagattttgctgcgcaaacccggagccttggcccggtcggaagctctcgatcaagcccgccgggaaggcaccttcaccgccgagcacgaagcgttctggacagcggcgaaggccgcgaccggcgaggacgccgccggcacccgcgagctgatccaggtcctgttgctgcaccggcacatgcgtggtcaggacgtggccgccggcatccgggctgcgttgtcggtcggcaccgcgaccgctgatgtcgtggcggtcgaggcccgcaaggccgcccagaacgccggacgatcacccacgatcacagccggcccgccgccggcaccaccaccccccttgccgccaccggcgccgccgccggtcacggaacggaccttgcagcgggtcgctcgattgcccgccgaccaccggccgccgccggacctgaatcgctgggaccagctgttacaccaccggagaaaggaatcatcgtgagccgtattccgcgagctatcaccgagaacgccgctgacgcggcgatcgagacctcctgccgggtcctgcacctgccgaccgtccgcagccagttctccgagctgatcacccgcgccgaacgcgaccagctcagctaccgcggcatgctcgccgagctgctgatggccgagtgcgaagaacgcgaccggcgtcgttcccagcgcaggttgcaggccgcggggttcccccgccagaagtggctcagcgacttcgattacaccgcgaacccgaacatcaacgccgctttgatcaacaacctcgccaactgcgactgggtccgcgccggccagccactctgcttgatcggcgactccggcaccggcaaatcacacctgctcatcggcctgggatcagccgcggcgatggccggcttccgcgtccgctacaccctggccgcgaagctggtcaacgaactggtcgaggccgccgacgaccggcaactcaccaagaccatcgcccgttacggccgcgtcgacctgctctgcatcgacgaactgggctatctcgaacttgatcgccgaggcgcggaaatgctgttccaggtcctgaccgaacgcgaagagaagaacagcgtcgcgatcgcgtcgaacgagtccttctccggctggacccgcaccttcaccgacccgcggctctgcgccgcgatcgtcgaccggctgaccttcaacggcacgatcgtcgagaccggcaccgactcctacaggctctcccgaaccgccgcgaaacagcccgccaccagcggatcctgaccggcacgctgtcgggcggacccgaaagactgaattcggcccacaggtggggccacttcaagccgccctggtggagccacttcaaaccgtcacgctcgccgcgggtggggccagttcaagccgccctggtggagccagatacaaccgtcatagccagttcgagatcgcccggtgtatgccgaccgtgcccggagcgatcggcgcgttccgtcgcgccgcgatccaggacgccggcggcgtctccgcgcaaaccttggccgaggacaccgatttcaccatgtcaatcctgcgggcagggtgggacgtcgtctacgagcccgccgcaatcgcctggaccgaggcgccggccaacttccggcagctgtggcggcagcgttaccgctggtgttacggcaccatgcaggcgatgtggaagcaccgggacacggtgcggcagcgcggcccggccggccggctcggccggcgcggcatcgggtacctgttgccgttccaggtgctgctgccgatcaccgcacccatgatcgacgtgtacggggtgtacggcctgatcttcctgtcaccgctcacggtggccgcggtgtggtcggcgttcatggccgcccagatggctacggcggcgatcgcactacgcatggacggcgaatcgtaccgcccgttgtggaccctgccgttgcaacagatcgtctaccgccagctgatgtatctggtggtcatccagtcgacggtgatggcgctgatcggcagccgattgcggtggcatcggatggtccggatcggcgccgcccagcagcatgccaccggagtgcgcgccagcgccgcggcgaagagttcttgacccggtgtcacccgctcagatcagccggtcggccggcacgtagccgtgctggacggcgaggtcgccgaggcgcgttccgcggccggcgccggcctgtagtgcgagaagctcttccagttcctggcggctcaggagcccctgccgaaccagctgctcgccgatacggcggcggccggtaatcgtggcggcagcgccgcggaagcgacgaccaacaccgttgagggcgaccagagtaagcggagccagacaggtgagcaggctgatcccggcccacaggtagagcgaccaccagtcgtggtgcagcagcagcccggcgctcatgcatgcggcggcgaccgcggcccagcccaggtgcggccggaaggtgcgccaggtgtcgccggtggcggccttgcccttcgcggtcaccacatacgccagaggccggccggcgagttgggcggcggccgcggccacgtacaccggtgcggtcatcagctccagagccatgccggtcaaaccccaggagcggcgttcgtgctcaaccaggttgtagcgctgggtgatccggaagaagcccaggccgacggcgaggttcgcgacgaacagcacgccccagaccagagcgggcagccgggtcaccgacacgccgccgaccaggtagatcgcgctgagcgccaggccgatcacccaggacgcggcagtggtcgggtaatgcgactgcagggcgaagaacgccagccgctgggcccggcgcggcagtcggcgcagcagcgccggggagtgccggcgagcgatctcccagatgccgtacgcccagcgtttctgctggctgaagaagtccgagtaggttgccgggccttcgccgacggccagaatgtccggggtgtagacgccgcgccagtggttgccggtgccctggttgaccgccgagtacaccaccatcgaggtcaggtggtcctcgatgatgcagtcctggtagccgccgatctgcgcgaacgcggccggccggtacagatggttggtgccaatcagcagcggcgcaccgtgcccgttgccgccgcgctgcatgatgccgtgaaagacgtaggccagctcggcggcaccgcgggccacaaacgaatcgccgaggttcgcatacacctgcggggcaaccacaaacgcggtgtcggggtcgcggaagtagccgagggtacgttccaggaagttcgggtacggcacgtggtccgggtccatctgcgcgacgacgtcgtagtccgcctcgtgcatcgaccgccacgcgttgtggttgccatgcttggtcttgcgccggaacggcccactgtcctggttccattccgggtggcccttgcggctgaagtgccgcacgccgatctcggcgcacagccgtgcgacttcggggtcgtcgccctcgtcgagcagccacacgtccagcggcccgtcgtgccggatccgcagcatcgcccgcagcgtggccatgaccaggtcgaccggctccttccctggcacgatcgtggtcagcaccgccacgcgcagcccaggtttcgccttgaccggcaccggatcgaccgcccgcgccgcgaagtaggcgagaacccaggtgcgcagggccacgatcagctgaagcacaatcatcagccccagccccgccgccatcaccacctgaccaaccgccgtcaccgaagcgaaccggggcaggttgccaggcagcaccagatagacaaccagggcgacagccagcacgatgtgcaaggccgcgacgcccatcaaggtccgatgcgcacctgggctgagcacccggcggtagagcacggcatcgccggcggcctccatacgcccggcgacctcagtagcgtcgcggccgtagagctgcccggtagcacggcgctcaacgccatcgggacgactgccgggaagggcttgcttggtcacggcccgactatcggctcagcgcagcagaactgaagcaaaacgcctccgtccatcatacgccgcatcggccaatcgccgtatggacgagcaccgcggccaggcggtgctggcccaccggtgggcgccgatcaccggcgagctgccggtgacggtcagcatcggggtcaccgccgcggtgcccagcggcaccgtccaaggcgctgcatgccggtcacgagccgtgccagcaggcgatcgtgtgcacgccaagctgagccagccgtccggccaccaggcagcctttcgcggtggggaaacagcagcggcgaaaaccttcaccttgccagggtcattgccgatcacctacgcccacatgaggaatcggatgggcgatgcgtaaatttcacaccggtccgggcatcgtggccgggcgttggcgtggtgtcgcgggtatgaccgcgatctgggtggccttcctgggtgcgaccctcgccagctcgccgggagacctggtgaggtacgtcctcgacgacggggtctacccgctgggcgtcgtcgttgccgcggtgatgtcactgttcgccctacgccgggggccgcgcgaacgccgccaatggtgggcgttgacgctcgccggcaacgtcgcgtgggcgacggcggacggatactggtgctggaacgacgcctggcagcacccggtcgacggggtgtcgatcggggacgcgttgctgatcctgtcgtacctgctgcagctgatcgcgatcggaggggcgttcgccggcagcggcggcttgcgtcagtggcgtggccagctcgacggcgcgctggtggcgaccgcggtcggactcgccggttggcagctgatggtgagcccgcggctgcacaccgggctgaccgccaactcggtcgtgctggccgtctacccgttgctggacgtggcgttcttcatggtgttcgtctcggtcggcctgtccggccggcgccggctcccgctgcccgtgctgctcgtcgtgatcggcaacctctggtcggtgctgggcgacctcgccgtcgcggtggcgggcctgcgcaacctgactctcgacgacggcctggtcaaagccgtgtacctcccgatgatcctgctgatgatcctcggtgcgaccatcgacgcccgccggtccaccgccgagcaggcagtggagcgctcgctcgcctacgacccgggcaacgtgcccgtgctggtcgccgtggccggcgtcctgctgtgggcgggccgggatgcgctcgccggtcggatcggggcggccgcgctgatcgcctccgccaccatgatcatcggcttgacggtccgcagccatctgaccctgcgcgaccaccggcgggtcgctcgcgaactcgacgccgccctcgccgaacagcggcgactggccatcaccgacggcctgaccggaatctacaaccgccggttcggcgaggagctgctgcaactggagtccgaacgggccgttcgcgaggccggatccgtgtccatcgtgctggtggacctcgaccatttcaagtcggtgaacgacacctacggccacgaagccggcgacgcggtgctcatccagagcacggtccggttcaacgccgtcctgcgctcgacggacgtgctgatcaggtggggcggtgaggagttcctcgccgtcctcccggggatggacgggcacgaggcggccgaggtcggcgagcgactccgcagggtgctcagcgaccgtccgctgcagttgccctccggacagcggatcggcgccaccgcctccttcggcatcgcctccgtcaccacggccaccttcccgccggaggccgtgctgcaagccgccgacgaagccctgtacgcggccaagaccgccggtcgcaaccgggtcgtccgggccggcgccgcggccggacagcccgacctcagcgcatgtccggccgcttgaggttcggtgccgaccgcgtgcttcccggtattggatgtaggagtgaagaatcgtggcatcggcggctcagtgcagccgcagtgcagtgccacagcgccgcctcaagtctcggtccggaccggacaatggtccggttttcatcggttgtccggcccgagcccgacctcggcgggtatgtgcgatgtcggcggatgggagaccgatcggtgcatctctcagctgaaggtcgcagttgccgatcacgttgcctgagggtcgcacgcgtgaggccggcgtttcgtccgcgcgtctgccgagccgtaccgactttctcgtggtggccgtggagatgacggctctcgccgcagacaggggaagggacctatgaagtcgttcctgatgcgcaccaccctgacgaaggcgcaccagatcagcttggcgatcatcgttggcctgctggtggtgccgactgtcgtgtccggctggcaactgtggtcggccacgaagaagatcgactatgtggcgcaggtcggcgtccccggagcgcacctcatcggcagtatcgacgggctgatgaacaaataccgcaaggagcagtggcaatacctggcgcttcaccccggcgatccgcagctggcggagtgcacggactcgatgaccgacgagaaagctgagatgctggggctgttcgccgcctaccgccagctgcctctgcaacagcgaggtcgtgaggaactggccaccttccaagcggactggcgcgactacgtggatgtcaccgccaacgaattgacactggcggacagcggtcaataccaggcggccatcgacaccttcaataccggtcacggtcaagcaaaatgggacagcttgaagaaggacctcgcggcatggcgcgccaacgatgttgccgtggcctccgcctaccgcgccacggccagacaatgggcgcggtggagtgtggcggcgatcgtggttctgctgacggcggcgctgttactcaccataaaggtgagccgtctgttgaagacgcggctcacgcggggtctgcgccggctcagcgcggccgcgggcggtatcgcggccggcgaggtcgaccagcagatcgaggtcgacgcggacgatgagatcgccgaggtggcccgggccttcgccgacatggtcacctacctacgcggggtggtgaacacgatgcaggaccaggcgcagcagctggcgaccatggcgcatcacgatgccctgaccggcctgccgaaccggcgcgcatgggatcttgccatcgccgacggcctgaaggcggcacatcgctcgggcgcgcaactctgtgtagcggtgatagacatcgaccacttcaagtcgtacaacgacacccacggtcatcctgccggcgacgcgctactgagaacagcggcgaaggcgtggcgggccgtgctgcacccatcgcacctgctcgcccgctatggcggcgaagagttcacgatcatgaccagcaatgccacggtcgaccaggtcgttgcgatcgtcgcgaggctgcgtacggcgacaccgtccggtcagacgttctcggcggggatcgcggtgtgggacggctcagaaaccggggaacagttggtacgtcgtgccgacgatgccctgtatcgcgccaagcacgccggccgggaccaggcgcaggttgccgagctggcgacgcggtgatgacggccaccacctggggagatcgggaagtgccccgagcccaatgacgatatgcatcagcctgccggacgaccctgtcgccggctgaaaccgaacggaaactaaacctaagatcgactagcgcccggccgacgtacgcgggtgtgtctgatccgcaggtagcacccagcgattctggcttcaccctgatcgaggtcttggtgtcgctggcagtgatcagcacgctggcagcggccttgtcgccgtttctggtgcgttcgatggcggtggtcaaggagcagcgtgagcgcgaggtcgcggtgcaactcgctgatgacgccatggaacgggtgtcggcgctgaccggcgccgccgcgctcaccggccgtggatacgccgccgccagaacgcagtgggacgcggcgacctcgtccagcacccctgcctcgtacgccgcagccgtcggtccctacctgcagtcgatgagcctgggcaatcccttggacgtgagcgaccccgccaaggcgccttggctggcctgggatctggacctgccggtctcggcgaccgcgggggcgtcggcggggctgcccaccgccgtgatcaacgctccagtgaacggcttgagcttccaggagaactactacctgggcatgtgccgtcaacagttcggcaccggaggaagctgcgacaatcccgatacgcctgacccggacatcacccgcgccgacgtgcccctgctgcgcgtggtcatcgcggtgacctggacgaaccactcgtgtgccggcggcatctgcacctacgtcacatccggactggtgagtgacgtccaggatcccacgtacaacctcaaccggccggcgccgacagcgaacgaccccggcccgcaggtcagttacgccaagctggcgataaccgggctgcagctcagcgccacgggtggtcagctgccgctggcctggtcgttcaccggcctgccacccggcctgaccggctccgccaccggcctggtcaccggtacgcccaccgacccgggaaccggcaagacgtacccggtgaccgcgaccgtgaccgaccagttgggccggtccagcagcgtgacgttctcctggacgatcgtgccggcaccggtggtggccaaccccggcaaccagtcgacgcagacgggcaccgcgacgtcactgaccatggcggcgaccggcggggcgaacccgatcacctggtcggccaccggcctgcccgccgggctcagcatcaatgccggcaccgggatcatctcggggacgccgacggcgaccagccgcctcgacgccacggtcaccgtgacagcgaccgacaaaatgggccggtcgacctcggtgagcttcacgtggaccgtgaccgcgctggctctggcgcccatcgcgacacgcaccgacagcatccgtgactcggtcaacttcaccgtaccgcgaccgacgggcggaaccggcccgtacacgtaccggatggtcaactaccccggcgactactccggcgagatctcgatcaacccgtccaccggcgtgatctccggcaaggtgtggtacgccaaccgcttcttcaccaccgtctacgtcaaggacgccaccggcaccgaggtgtccaccaccttcctgtggaatgtgctgccgagccagcccaacgacctgtacatcaccgtcccgaatcccagcaaccccgatcagacgagcaaggtggggcagccgctggaactcgatgcgtacgcgccgagcggcagcaacagcggctacgactgggtcacctacaccaccgggctgccgccgggactctcgatcgccacgaagaactactactacggtgccatcaccggcacgccgaccacgccgggcgtctaccgggtgaccctggtctgccaggacgcgaactacaagagggccgtcgtgatgttcgactggacggtgacgccatgatccgccgccagatctgcagccggatgggcgacgacagcggcacctcgctgattgaggtgatggtcgccatgggtgtgatgagcgtcgtcatggcgatcttcaccggcggcgtgatccagttctaccgctcggcggacgcggcggaagagaccgggatcacccagacacagctacggctcgcgttccaaaccctcgatcgtgaagtgcgctacgccaacgggatcagcttgcccgccaccgccgcgatcaatggcgcctggtacgtggagttctccggcatcgacccggccggcgcccaggtctgccggcaactccgactggacgccggcggggtactgcaggagctgacctggacgccgggctcgccgccggccgccggaacccgcggccggaccctcgcctccggcctgatgtcgcccggcggcagcgtgccggcgccgttcgaccggcaggcggccggctcgacaccgtacgcgtcggcgtccacctcagcgacgggcactgccttctcccccgacttgcagcgcctgcgggtgcggctgaccacccgggccgggtcgaccacctccgtcaccgacgtgacgttcacggccctcaacacctcgcgtgacaccgcagatcccaacatctgtctcgaaggacgcccctcatgatccagctccgaggcgacgaccgcgggtcgatgccgctggccatgctgctcagcatcgtcggtgtcacactcagcacgctggtcggcacggtggcggtcagccagatcaccgaggcccgcaccagctcggatcgcgctcaggcgctcatcgccgcccaggccggcatcaccgtggcgacgggccagttccgggcggccaccgacagcacgggaaccggggatccggcccgtctgcccgccggaccgctggccggcaacgtcggaccgaacggcggcgggcgctaccaggtgaccatcgcctaccgcgacctggacggcaacccgctcaccgtgccgctcaacgcccagcccgcgacggcagtggtcgtctccaccggcatccaggccgccaccggggccttccagcagggcaccaacggaacccggacgctgcaggccacatacgctttccgactctcgaaccagaacatcccgggcggccagatccacgtccggagttccgccgccgatctgtgcctggacgccggctccgcgcagcccgtggccggcaccccggtacagatgcgaagctgctccggcgtcccggccccgcagatctgggcgtacaacagcgacctcacgatctcgctggtctcctcccgcaccggcatcaacccgctcggcatgtgtctggacgcaggatcaccgcataccgccggtgcacaggtgaagatgcagaagtgcaccgctaccagcccaccgccacctcaacagcagtggagcacgaacgactcggccaacatcatgggcaccagcaacggatcaacgttggacaactactgcttcaacgtgcagagtccggatttcgccggcagcttcgtcgtgctgtccaacaccaagtgcaacggcaactacgacaacgtacagacattccagcccgatcccgccgtcggcgccggcgcggccggaccggccaccaggcagctggtcaactatcggcaattcgggcgctgcctggacgtgaccaatcagaacgtcgcctcgacctatctgatcgcgtggccatgcaaacaggcgccgaaccccgcgaacatcagctggaaccagaaatggaccctgccgcccgccgtcaacggcgcacacacggccaccggtcgcatctacaccaccctcaacggcaccgaatactgcctccgcagccccggcgtcaccagcggcgcatatcccaccatgacgacgtgtacgagcacgtcctccaccgccgatcagacctggaccgtctacggcaacaccggcagctacacggcgagctatcagatcgtcgacaacgccggcctctgtctggccccggcagaccctacggcgtacccgaccgaggtgttgccgtacaccgggccaacagtgagccgcatcgtccttcgcacctgcgacggctccgcctggcagaagtggaacgccccaccagacgtgtccaaaccctcaccactcaaacaaatcaccgagcgttagcatcggtctccgtgccgcacttcatcggagtcggctcaaatcatcgccaagagacttgccgaagatttcctgacgtcgaccgctgagtacggtggacctcctcggcggcgatgatcaaagcggcgccgagagagcccttgaaccgtgccaaaaacgcaaaggcctcggcggacagccgcatcgaaacataaacctcaatctgcccttccggctggcagagatggctgtttcatgcaatgcagcggggatcatcgctcgcatgtggaagatcaccgactacgccgtttcctgactgccagtggactccacaaccggcgcgggcagtggcgagcgggaaagtgatcgacgtgcacacccatgggcctcacttgacgtcccagttaccgctgactgcctgggtgctcatggcacgggatttggactgttcgtcgtcaactccggcgagcgaatcctgccgcggcaccggtgattgcggcccggaatcgccgcggcagggaactcgcatagttgccggttgcatgctcgacgagactgatggtggcggcaacgacggatacgtcagtcgattctcccaggggtgactggggcgcctcgacgggttaacgtccagcagtatctgcgcatcctttccggacatgtccgattggcagtctcagatgtttacgccgaaagagtgtgacaagccgctcacgcagcgacacattcggccgcttatttgaatttggcccgttcggttgatccgcaccgatgcaacggatgttgatgatgtggcgttcctggtctcccctccatgaaggccataactatgcagctgaaccacattgttcgcggcgcggcaagcatcgccctcggtgtctctgtcgcgctggctctgaccgcgcccgcgtgggccggccgctcgaaggacccggccggcgccaacggcacagtgaagatcgacgcagttccgttcgatcctaagatcagtaataatccgcacgtaacgtgcgagttccgcgtgaagttcttcaacttcgacaccaacgagcatggcaacatcgtcttcaccgcgcagccgccgagcggcaagggtaccgagctgctgcgtcagaacaatgtgttgctcagcgacgacgcggcaaagggcggcgcgccggatcccgacgagatctacacgtactccgccggcgacctgaaactggacgggttgaagctgcagcccaagcagggctaccacatcaagctcacggttgagcggatcggcgcaccgggcgccggcaagcacaaggtgttctggctccagccgtgcgccagccagaatggcggtggatcgagctcgacgccggcctcggcaccgtcctcttcgtcgtcgaatccggtacctgccggcaacgagagcgcgctgcccatcaccggctccgcggccagcacggtcgcggctgtcggcctggtcctgatcggcagcggcgcggcgctcaccatacggcgccggcgcaagttcaccgcctgatcaggcctgatacgtcggcgggctctctgcagactgcagagagcccgccgcgatgaacgtgtggtccccgcaacacgccggccaggatctacgacgaccgtcaacgcccaggcacagatgccggcatccgcgtgatgacaaagaggcccggcacaaagggcaagccttacctttacggcgctgtcggtcaaaacggtttgactgttccggtctcacccccgtaaatccacaagaagacgatcggcaggaggctggctggccacctcacgcagctgtcagcgtttcggcgtgcaccggccgacggctacaggctggcgcggatctgcttcatcgcggtgatctgcgcctgctggtcggtaatgatcttctgggccagggtcctggcgtcggtgttgacgccttgcgcgagttcctgctcggccatcgtgacggcaccctgatggtgtttgaccatgaccccgaggaactgcttgtcccacggggcgcctttggcgttcatcagtgccgtcatgtcgagttcgtcgatgccggccatgtcaccgtgctccatgccctcccccgcgtcgctgccggcgctgggcatgggcttgccccaggcgcgcagccaccggttcatggtgtcgatctcgggttgctgagcggctttgatcgccgtggcgagctgcgtgacgcggggatcaccggcgtggccggcggccagggcggccatggtgatggccgaccggtggtgcgggatcatctgctgcacgaaggtgatgtcggcggcgttgaacgccgcggtcgacgccccggtcgtggccgggctgctttccggggcgccggccgggccggcggtggtggtgtcgctgcatgcggacagcagggcagcggcgcaggcggcggcgccggcgagcagggctcggcgccagcggttcgagggcggcactgaagtggacgtcatggtgttgtggaacaaccttcccagcgaagcgcggacagacagcaagagcgttcgtgttggccgccggcgaggcccggtgctgcgcatgccgcacagcaccgggcgtcagaccgtgacccgttcggcgtgatcagcctttgctgagcaggcccttcatagtggtgatctccgcctgctgcgcggcgatgatcttctcggcgagggctttggcgccagcgttggaaccctgcgcgacttcctgctcggccatgctgacggcaccttcgtggtggctgatcatcatggtgaggaactgcttgtcaaacgcggcacccttggccttgcccagcgcgcccatatcggccggcgacatagcgccgggcatcgcgccgtggtccatgccgggcatggccgaagcgtccatccccggcatgccggacgagctcatcggcatcgggtggccccacgcgctcagccactgcgtcatggtgtcgatctcgggctgctgagcggctttgatctttgcggctagatctttgacctcgctgctggcggcacggccgtcggccagtgcggccatctccaccgcctgctggtggtgcgggatcatcatgctcgcgaacatgacgtcggcgtcgttgaacgtcgccgtcgccgccgcggaagcggtcgtggtcgtcggcatgccgccgtgattcatgccggaatccgacgaggtgtcgttcccgccgcaggccgagagcacgagcgtggcggtcacggcggcgccggccagcaggccccggcgccaggtgggggaagacagcatggaggtacgcaacatcgcggtattgacctttcgaacagacaacaggtgcaggcgcaagcgccccacggcccggcacagggtgccgtggctgcggggtggggctcctaaatgcgcagcaccgctgccgaagcgagggtcaatccggtaccggtgggtggcggcgcccggctggcacgccgctgcgacgcgccgaggcctcccggaaagaggccggggcgggcgacggccagcagcatcatcgccagcaggatgaccacggcgagaccgcccagcacggccaggcacacactccacgcgccgtggccgtgatcgtggtcgccggggcaatgatcatccgggcattccccggacatggcggcggccacgaacgccaccaccggcacgctcaccaccgcagacatcgcggtcatcgacaccgggccacgatcctggacacggacgccggcatggcccagggtgtgcatcaccgccaagccgaacacggtgcacaacaacagcaccgtccgggctccacgcccgatccctgccgcggttgcgccgatcacggcgcccacgatagcgcgcactccggtgcccgtcaggggcgacgcggatcagaagccggcggcctgtcggcggcggtgaccccatgggtcaggccgggcggggtccaccagcgtgatccggcaccgcggcgtagccgtgtggccgcaaaccaactggcaatatctggttaccgcgagcggcaccgctcacgcgggccggctatcgggtcgcgggcgcggtcgggaaccgaaccacaaagtcgcagcgcagcaagtccgatcggcgcggacacgggatcgctgacggccggcacctttcaatccaggtcactgtactcctgcaggagcgcagtgatctcctgagcggccgcgttcagttcggccaggtgctcgggggtgaactggtgaggttcggtgcgcaggatgcagtgcgcgccgatgatctggctgcggacggtgaggggcgcggtggcaggccgatgaccctcacccgccggttcaccgatgcactcggagccgcccggccccgtgtcggccaccgccgtatggcagctggcgtgctgctcgcaaccgccatcctgcaggcggtcagtcctttgttcgtgggtttcgaccagggcgaggccaacgatcctgtccttgtgccacccggcccgttcttcgggatctggggagtcgtcatcgcaggatctgtcgcccacgcggtgtggggactggccgaccggcggtccgccgtggatccgtaccgttcggtgcagctgccgctgtccctggtgcacgtactggtcgccgcctggctcctggcggccgagcacgcgccttgggcgactctgccgatcttcgccatcatggtggccgtcctcgtcgcctgtctgcgcgccgtgctagcgagttccgagataccgcgggccacccgctggctgctcggcgggaccgtgggaatctacgccgggtaaagcagcgccgccgtctagatcaacgcggtcaccctccttcccccgggtctggtcaacgccacgacactcggaactctgttgcaggccagcgccatcgccgcggcagccgcaatgagttgcatcatcatcggattcatcggcggatggccgccgtacgttgctgccgcggcctgggccctcaccggagtgaccctcagcggagtccggttccacacaccggccatctgggccacggccgcagtcgggctgcttgccgtcgccctcaccacccagcgctcgatcaagagcgggcaccgtcccggtacctgaccgacgcctgtcccgtgagccgctgcgggcgtcggcgaccgtcaccgcccctacggtcatgtcgatcgacaactgcaccgagcttgcaaccgcaggcggctacgtgccggatcgggcgcgccgatgaagccgagcaggaagcgattgcgtgcacgatcggaggtcctcatgccgccaccacccgtccgtacagtgcgtcaggctggccgtcccatgagacctggacgtaggtcggcgacaaccggcggtagctggttggcgactccgtccagggcgccgagcagcgcgtgatcgccggtgagcagtctgggctccgcgccggccggccgcgagtcgatcagcttccgcccggccacaggctcgatatcaccgtctgagacgcctggttcacgatcaggatctaattccgggagacctttgatggatcagcccttggtcgtcgtcgccgaagacgaccgcgacgttcgtgacttactcaccttcttcttggagaaagccggataccgcaccatcggcgcccatgacggcgctaccgccgcgcggctgctgacgactacgcgacctgcagcgcttatcaccgacgttcacatgccggacatgaacgggatggatctgtgccggctggcccggcgcaccttcgccacgcaggacatccccatcatcatgttctcggccaacactcaccagcacgacatgcaggccggcataaccgccggagccgacagctacctacccaagccgctgtctccgagcgcagtcgtttctcggctggacgagctgctgtcggccgggggtttacgccggcgtgacgacgtcccggcgcacacccgcgccgccgtcggaggcgttttcactctggccggaagctagccacttgtggaggcgccggcgcgcggagcatcgatcatccgttcctgaccgccccgtcgcgtatcagcgctcggcggtcaacgagagccgtgtgctttgcgccgaggctgtggtgctctgcgccgaggcgtagcaattttgcgtcgaggccaccgcataccctggtccggcgcgcggtcctgtgcggatgcgccatgcgggtggcatttttcgttctgactaccggtcggcttcgacgtggcgcattgacaatcttcgttgaccacttcggcaatgccggctgccacgtggcggatggtgttcacgagcagatcggagctgtacggcttggtcaggaacggagcacgggtgtcgagtcggtagctgcgggtcgccaggtctgcaggtatgcccgagaggtaaaccgtccgtatgcgcggccgtaggacggtgatcaagttggtcagctcgccgccagacgcgccgggaaggtgaacgtcggtcaggaggacgtggatcgggccggtgtgggctccgcaggcggccacggcttcggctgcgttcgcggcgcatatcacctgcatgccgtgtgacgtgagctgcgccgcggtgatctcccgattgtcggggtcgtcttccaccagcagcacgaccaggcgcgatgcaggcgcggtcttggccctgcgacggcgaagcgttttgcccacgggttgagccgattctgatagtccggtcaaaggctgcgacgaacgtttacggtgctcaagcgtaatcccggcatccgcgtcatgggcctgattgctgtcgccctgcgccgaggaggaataggtcctaccgaagtcgcggccgccagcttgagctttgacggccagacgcatgctgccgcgcggggctccgcggtcagagcgctaaagaagatctactcgttgccgattcgccaggaggtgacgcgcgcctgagccaaggaggaggcatggccccgaccccggcgttgccggttcccatcacgcacatcgggccgctgcggcacctggcagtacatccccaccggctctactcacttggccggttcgacgaggcgctcacggtcgtcgaaaagaacaggtggatcgccgaggcgctgggtgactcggatacggcacgcagcgtcctgcagacccggctgtacgtgttgactgaactgggccgtctcgccgaggcggaaacccttggctggcacctactggatcacgccgcctcccgggtggctcaggcaaaggccagcgccgatctcgccgacgtgctcgtacgaatgggccgcctcgaggagggattgcacctgctcgccgcggccctgaacatcctggaggggtgtccgcgggactggcgctattttgccgcgatgtcctccgtcgtggaagcggctcgctgggcggatctgtacgaactgtccgacgcggcagccgtcgcggacccacggtggctttccgccgatcccatcctggacggccagcgcgccgagatgcttctggaatgggctctgcggctggagcacgtaggttgccaggatgaggcgaccgcccgctatcagtcggtgatcgcgttgacccggccgtgggtcgaccccgggaccacgaccggccctgatgcggatcgcgccttggtctccgctgtgctggcatgtgcgctggccaagaccggcgcgatcgctgaagccatcgagttggcggaagcggtgatccctgttctgcgttctgagggacgcttgttcgatgctcgactggcgcatctggcctacggcgttgcccttcgcaaccgcggtgagtacgaggccgccacccgagagctgatcgccgctgagcagtcgtgtgctggttctggtaccagtgctggtgcgccgcggcatcgactgattttccaattcgagttggccctggtcgacttggaggccgagcccggctcggcgagcggacgcctgctctccgccctgcgggggcatgccgagcaactctggcggctgcggatggaccgggtcgcgatgctgcgccaggcccgccatcggctgcggcttgaggccgctcacgcctcggcggacgccgccgcgcagaccgatccgctgaccggcctggcgaatcggcgcgggttcgaccgacgactcgcgacggtggacaccgatccacaggcggcaactgaccccctgtgcctgctactggtcgacctggacaacttcaagcagatcaatgacggcttctcgcacgcgatcggcgacgctgtcctacaggagatcgggcatgttctgcgaagccagagccgggcgtgtgatctgcctgcccgattcggtggggacgagttcggggtgatcttcgcagccgacccggagacgagtgtccggatcggggcgcggatgtgcacggcgatcaggaaccacgactggcagcggatagccccgggtctccgggtgaccgtgagcatgggtctggcaccgttgcagcccggcatgagcagcaaggagctgttcgctgccgccgacgatcgcctttatcaggctaaacgaggtggccgggaccggcttgcatcctagcccttggggcactctccaccgatgggcgtgaccgttggtctcatcgtgcgctgcctgccgcaacggggatgcggacgctgatccgggtaccgctgccggaacggtcggcaggaggggaaaccgcgatcgtgccatggtggcgctcgatgatcgtccggcacagggcgagacccagacccgtgccggcgatgccgtgggtacgggcgcggctggagcggtggaaacggtgaaagaccagttcccgttcgtcgtcggggatgccgatgccggtgtcggtgacgtccagttcggcgacgccgtcattgtcgaccaggacgacgtcgacggggccgccgtgcacgctgtatttgaccgcgttgtcgatcagtttgcccaccatttgccgcagccgtgcctcgtcgccggcaacggtgagtcgcggcgggatgcgggcccggatgtcggcgccggccgcctgtgccccgggccgggcggcgctgacacgttcgccgaccagcgcggcgaggtcgacgggtgcgatatgcagttgcgtatggccggaatccaggccggccaggtcgagaagctccccgacaagggcaagcaggtgactgttgttgcgatcgatgacctcgaccagatcccgcacctctccgaatgcggtggtgtcgtcggtgtcgcgcagcagttcggtgttcgcgctgatcgaagtcagcggtgtgcgtaattcgtggccgaccagggcgatgtattcgtccttcgactggatcagctcccggcgaagctcgtcggcgcggcaccgttgcagaaaagcgccgacctgggcggcgatcccggcgaccagggtgacgcaggtgctgtccttggtctcggcggtgggggcgaacaccgtcagggcgccgagggcctgatccgccccgcgtaccggcaccgccagcgctgcccgtagccgggagccggtgacgatgtcggcagtcatcggggctgcgccggcggcgaggtcgggcacccagaccggctgctgctcatgccatgcggttccggccaggccggaaccgcggccgaggctggccggcacgtgcacggccggacgctgcggatcggtccaggtggcgatcggatgcaacatgtcgctcaactcgtcggcgagccacagctccgcgtgcgcccagtcgagcgcggtaccgacggcctgcactaccgctgcggccgcgtcggcgggatcggtggaggcgatgaacgcgcgatgcaccgcgagttccgcgtcgcggaaccggccggtgcggtactgagcggagatgtcctgggagaccgcgaccgcacccagcacgctgccatcaggcccggcaatgcgctgagcgttggtgcggaacaccagccgttgatcatcgcgaccgaccaccagatgctcgacgtcgcggacatgttcaccggccagagcccgtaacagcggcatctcctcggcggtgaagcgacgcccgtcggggtgcagcacccgcaaccggcgcgcccactgcctcggcgacagtgccggatccgcgtcatcgtccaatgcgtaccgcagcgcctggttgaaccgaatcagccggccagccggatcacatgccaccaccccggtgtccaggctgtccagcagggcctccaagaatgctcgctgctgttcagcgtcctgatgcgccaccgccagctccccggcgcccagcagggccgccacctcactggcagcaatcgcggcgagatcgcccaccagggtcagttcccggtactcccaacggcgtggccggctgtcggcgacgcagaacgcgcccagtaccgcaccgcccggagcccgtaacggataaccggcataggcgaccatccccagctcagtgatcgccttactgtcacacagacccacgtcagcgcgggcatccatcaccacgagcggggcctcggtggcgaccacgtaccggcagaacgaatatgtcagcggcgtctgccgctcggtggcccacggctccggcagacccacggcgctggcgaaccactgccgatcctggtccaccagcgtgaccagcgacatcggcgcctccagcatccggctggccatcgcagtaagtcgatccagccccgaaaacgaccgatcaccgatcagaccggtagcccgcaggaccgccaaccggcgagggtccgccaccccggtcgggaccgcgccacccgtgggaaccacgccacccctccgccaactgtcagaccatgatcagtaacagcgtgcgccgcacatgcccccaccgcgccgccatcccgcacccaggtcactcattcgtgaacagcgacgtggtgtccgcaacatgcaaactgccggccgcgaccaccgtgacagccgcctgattccgttccggcccggaccaggaagcatcatgatccacttggcaagtatcacctgcataatgccaatgtccagacacccgtggtggtgccggttgcagccggcagccacgatgatgccgtgctcgacgtcaaccggctgggaccggtcctgccccgggtccgcatctctcaggacgggctcctgctgcgcccgtggtttcgacgcgcgctgctggtgccctgggcgaggatcaaaggcgtacggatcacgcccgcggatcgatggtcgggcaagaatgctgttcccggaggccacggctactacatggttcagatcaagctggccggcgactggcggcgggtcggtcaggctcttcgggtacgacactccctcctgccgctggtggtccgcgagcggctcttcggcgagagaggctcgtggtcctcgcaagaggtgatcttgttcagcggctacgagacgatccggatattgtgggagaatgcgggcggtgagtccggggacgaggatgacaactggccgcggatcaagcctgctgaagggtagctccgcctgatgcgacgacgtgtccggtcatggcacccctctgtgagcagcgcgcaagtttttgaccaggccagcgagccagcttccgacctcgaccaaccttgctgggcagcacagtcagagcctgaaagtcaccagcatgaccagaatcggccgcggcttttttcgattccggcccgcttttaggtgccgtagagcaacgataggccttatggcatcttgcgtaagaccaactgccgcctgagcgtctgatggcccggacatggcaacgatcctgatcgccgacgatgagcccgatatccgcgacgtcctgaccctggtcttgaaccgggcgggacatcgggtgctcgccgtcggggacggactcacggcgctgcgggtcgccgagcgcgagcttcccgatctcatcctggcggacatgagcatgccaggactcaacggcgccgagctgtgtcacgcgatacgccggcaccgcctgctgagcacggtcccgatggccatcctcagcagcacgctgcacttcgacgacccgcggctcgccggcatcgacgcctgctcagtcctgttcgagcccatgaccaacaaggatctcgtcaaagcggtcgagcatctgctggcggatggaccgcatcgccacagctccgaagcggggtccctcgaggagcgtcctccgcaataccgggtaccccgcctaggcagatccgatccctctcatgtccgccagacgtgaatcccgggcgacacctgactactcactccctcggacacctgccaccggacagcagagccgacggcgttcgaggatgggtcaatgcgtccgcagcgtcaaggatgcccagacgtgtttgacacggtctgcggcgtaccagccgactgccacggccagacgctggacgacctgcagccccaagcctccgcgcgccggcgcccgatgccggtcgacggccgggacactgttctcgtcgtgatcgaccacgtcgacgatgacctggccatcggagcggaacagcatcacgatcgtcggaggctgaccgtgccgcagcgcgttgctcgtcaactccgtcaccacgatgaccaaccgctcagccacgtcatccgcgtccgccggcgtcgcgatccggccggccctcaccaactgttgcaactcgcggcgcagatcctgcagctgcggcggacgctcgacatcccaacgggcgattacctcatcgacagcaggaggacgccccgtgatccacccgttcatgccacagctattgccccctacggtcaagattacgcaagcacgccaagagatgccccgcaaaaccaaccgcagcaatccagcagatgaccgggtcatccggtgtcctcaagggcgggatgcgctggcacggcacgacatatccgtccggccatggagcgctggcgcatcccgccctgatcaggccggaccggggaacgactccaggctctccacctgcaccgccgaggtgccggagcggaggccgacaagctcgccgaggtcgttgaatagcgggccgtccgtgaccggccccgggatctcgatcgcgagcgtccgggggccgctcccgcaggtcggcccgaaccggttgacgaagccgggaacggcggtgaacggagcggaaccgggaccgccgacggcccacacccggtcgccgacgcgaagcaacttcgggtggcccagccggatcgggccgatcggggccgcggccttgagccggatcgccgccggaccgccgccggtggaggtcaggagcccggccggtacgagcggacccggtcccgcaccgcccacgatctcgacgtcggccggtgtcgtgtgctcggtgagccctccggggacgaggacgaggtcgttgcggacgagtacgccgcagcaaccggtgcggtccggatgccgggcgacgtcgacccgcacgagcgtgtcccgcagcgggtccaggaatcgttccggccggtccgggtcgggcagcacgagaccgagaccggcggcgttcgcgaccaggacccggcggtacgcctccgcatctccggtctcggccaggcacctcaggtggcgggtgatgtccgcggcgtcggtcagcggcacaccgtgggtgcgcagcgagtcgagtgcccggacgaattcccgggtgtcgtgcagatcgcggaagcgtcgcagcggatcggggtcggccatggtcagctgggccagcgtggcgttccaccgggctatgcgagccagtagcggatccagccgcgccagatgccgctggacggcgtgcagcaggtgctgtccggtggccaggtcgccggcggggtcctcggcggcagccggacggtccaggtactgctgggcgttggtcagcagatcgcgcagcggcacccggaccaggtcgaggtcgatgctggtctggttcgcgtcccggaacacctcgatgaggatctgctgcgtaccggcgtcggcacgagccgagggccggtgtgccgccttgcgttcgcagaaccgttgccaggccgcgtcgacgtcgcgcgccacgacggtcgccacaagcgtccgcagctcccggcgaagccggtccccggcatgacggagctcctgttgaacggcgagctcgtggtggcggcgggacagcgcgtcgacctcgctgggcgccagcagggtgctgtcaatgatcttgatgctcgcgacgatgccggtctggatctcccgggccgtcaccttcaggacaccgctctcatcgatgctgaaggtgacctcgatcttcggcaccccccggggtgccggcggcaggccttcgaggcagaacgtaccgatcagggagccgctgtcgaccgcgccgttgaaaacctggatccggacgcccgtcgcccggtcgcggtgagtcgtgtacatcgcggaccgggtcaccggaatcgggcagttgccttcgatgatgcgggagtaccccaccacgccgttctcgtcggcggcctgaatccccagcgacaacgaggtcacgtcgtggatcaatcgttgtcggagcttgccgtcgatgacagcggactgcagggccgccccgcacgcgacagcggtgcgggggtcctggatcccggtcgcgctcagcccgaacaccttctcgaccagttcgcgcaccagtggcgaacgcatcggaccgccaaccagcaccagatggtgcggcgacctcggcaactcgtcccggaatcgggtgcagaggcgatgcagtctgcccagcggggcggtcagcacagaggccaggtcggttcgcgacagggtcagcgtgacgttccgctcgtcggcgaagccgaccagcacgtattcggcctccgagacagaggacagcgtgatcttcaaatgctcggccgcgacctcgagtcgttgccgggccggcccgctcgccggtgcctggataccttgacggccgagccgggcgacgagttcctcgacgatggcgtggtcgaagtcgatgctgccgaaccgggtgtccccttggacctgccgcacccggtgcaccccgtcggagacctcgacataactcgcgtccagcgtcccggcgccgaggtcgatcacgaccacggcgccgttcagatggtgctgcaaggaggccacgacgcaggccgcggtgggctcacggagcaggagaaccggctcgacatcggcgatcgagcaggccgcccgggtcgccgcggtctggttgttggtgaaataggccggcacggtgaccagcactcgcggtcgcgacagccgcatgtcgtgttcccgtgctgcccgggcgagcagctcatcgggtacgaccccgaactccgcccgggcgctggcggcgaccaggtcggcgacccgatcggccaggaagcgttcgaccaccgtacgaccgtgtgcgatcagccgggccgccacctcctccggccggtactcccggtcggcgatggaaaatctccggctggtgcccatcgcgcgcttggccgcggcgatgtgaccgaccagtcgggtggtgagcaggcgctcgccggcgagcccgaccagttcgtcaccgtgcacgtccaggctcagggtcgaggcgaacagatgctcaccggtttccgtcgggcagagcacggcgcggccggtcgcggtgtcaaacacggccaccgcgcaagtgctggtgccaaggtcgagtccccagatgccggcgaaacgacggtcgatctcctccctggccttcgcgacccagccgggggcgagccgttcgaacgcctcgcgcttgcctgcctccagatcgtcgagtgcggcgtcgatgtcctgctgcaaggcggccggcaccatcggatcggcgcgcagcaaccgcaattcctcccgcgccggtcggctgccggccgccagcgaccgcaggcagagcgcgaccagttccggatagtcgccggcgccgcgcaggcaggcgacggtacgggggtcctcgatgaccccgtcggtgtgcagcaggtgcaggcaggccatcgcggcaccgaactcccgggcctgcatgtagagatcgatcgcggcgtcgagatcagccgtctcctggaggatctgggccgctcccagagcgtcgcccgcggctcggcgggtctcggccctgtcccgcagcgcctcgacgctcgtgtcattctggtgtatccgttccgcgcggccgaactgcccgcaggcgcgatagagccgggccgcccgaagcgactcctgagccgcttcggcctgttgggccgccatcacgagatcaccggcggcttcctcgaatcggctccacgcggcgtgggcgaccggggtcgtggcgccgaagtggaaccggccggcgtgaaggatctcgtcgcgctgttccgccaccgccgcctggcaccgtgccacgacgtcggtcgcgcccgcgcgttcgagcacatccgcggagtgagccgccagatccagccggtccagcacggcccggacccggttcatggcaccgacgaagtcaccccggtcggcgaggtcgtggacatcgttctggcaccgcgccgccagccggatcagccggtcggtcagatgcaacgggcaggtgtcgaacgcgatgccgtagcggccccgccactcgtggcactcgctcacccgatcggtccggccggcttcctgataggacagcagggcctcgttgaagagccggtccgccaccagcagatcgcctcgacgcaccagcaggttgcggacctcgacgctccagcgctggtggcgcgccgcggccagaccggcgtccacgtcgatcaccgacgaggagcgggcacacacgtccaccgcggcgcgcagccgggacacgctgccgtcggccagacgcacggcatcggcgccccggccgacgaagcagcgcacctcgaagaggtccggcatctgcgactccggcagctcaccgaagaacgcctgccacacccggtcgtcgcgctccagcggcgtgcggtcgagccacgcgcgaagcacccgggtcgccgtgtcccggtccagcagctgcagctgcgaccagcgccgcagctgcccgatgacctcgttcacgtcggccgaccggccgagcacggcggacatccggtcccgggcgtgatgctgcaggccgggcaggcccagcgtggtcgccagttccagcaccgcggcgaacgcgtactggtcgccgtcggctacatgagcggccaaccagcatgcgtccccggtacgaaatgcctcgtgatagcggtccgcgggaatcctggcgttgtaccgtctgaccaggcccacggcctcccgcgggttggcccgcagcgccagtcggagcgcacggcggtagcgacggatcaccggccgtcccaggggcgggctgtcgaacccggcttccaccgcggcgagcgcccgggcgagacgttttccgctgcccccgaacatccagtcctgcagacccatccggcagatccggtcggtcagccgcagccgcggatccgtgtacgaccgggtcaccgggacggagaggagggtccgaagttgttggtctggtgcgcctcgccgtgattctgcatgacgacgaatgcatgatcaccgatcgtcacgcccgactgcgggggccgcagggtgtcgacgagttcctggagttccggccggctctccggtcgctccgcgaggaggtccgccaaccgcatcgcccaggtcttttcctcggcggcggctgactcctcgcccggtgacgaaccgaggacctcgtgggtccgcacgagctgatgctcgatcaccgcccgccggctctggttgccccggctcagcaccccggcgacctgtctgctcaccgtgccccacgcttcggtggtcgccgcttgcaccaatgcggcagctcccgccatggccagaatgtcaagctccacccggtggcccttcgacaggtcctggatcaggacgctcgaaacctccggacaactatgaccagaccggggtcggatcggacagccccggacagggtcgtatgaacggccagggtcgcccgatccgagcgcccaccggaccacccctctcgccactgagccgaggtgggctcgagaagagcccaccgagcatccgacaggtccgatcgatttcgatgtagttccatcccatgcctaccgaccggcgcgcaagaccgatgacgtgccctctccacccctgtcgggtcaggctcattccgattcaacggcgggctgaccatcgcatgtggtggcggaaataccgcccaggttttgtctgaccaccaaaacagcacactactcgaccggcgcggggacaatcgccatcaaataggggtgtcggagtcaccgttcccagaaacggacgatggggcagcaacagggcattgctacggctccagcgaagaagcggaaggcaggtatgcagcagatgagctggctgtcgaagcgtcggtatgaaaggcgcttactggttacggcgatcaccatcgtggtgctggtggccgtcgttgtattgggctactccgtatcctaccggcaggaagccatggccggtcaggcacagcgggcgcagcggctggctcaatccgcacagcaggtgaaattccgggcggccgatttcaacggctggcagacggcatacgcattggacatcatccgcggcgagccggaagccacggccgatacctcacccagccgtgcgaaattcctcgacgcggcccagaagttcgacaaagatctgggagccctggaactgttgtccacgtcgtctccggcggcaccgaccgtcgatgccgtcaggagggcgttcgagcaattcatgaccgtggaccggaaggtcgtggagctgtaccgcaccggcaagccggcggaccgcagggccgcctccgaactcgtcctcggccaagagatcaaactctacgggcagatcgccggcggttgtgatgccaccgccgcgctgtcggtctcggcggaggaaaccagtctcggccggctcgacgcggtgggagccgccacccggcgctacatcctcatcctgagcatcgtcgccgccgccctgacggtgctcggtgccatcctcgccgaagcgcgacaacgagcaatcgagcagcgagccaaagaggctcagcggatggcgagcctggggcacctggctggtggcatcacccacgacttcaacaacgtcctggccatcatcctcaattacacggacttcgtcgccgagaacgcttcgcccgagacgctgcatgacctcggccagattcgcaaggctgcaaaacgggcggccgggctcaccgcgcaactgctcggcttcatccggcacgaggccatccagccgcagattctcgacatcaacgccgcgatcgacgaagcgcaggccatgctcgcccgcactctcggcgaacacatcgagctggtggtgatgcgctcccccgagcccgtcaagatctgtgcggacgccggccagatccaacagattctggtcaacctcgccgtcaacgcccgtgacgcgatgcccgacggtggcaccttggtgatcgcggccggcgccgtggacctcgaggagaaccaggcgaacgtccacccaccggtggcggccggacgttacctccagctttccgtcaccgataccggcaccgggatgcctccggaaaccatagcccgcatcttcgaaccgttcttcaccaccaaaccgaaagggcacggcaccggactcggcctggccaccgtcctggacatcgtcaccaccgccggcggcagcatcgacgtctgctccaagttcggcctcggcacgaccttcaggctgtacttccccagcgtcgacgtgccgtacggcctcgcttcggcacgtcgcaccgatgcggcaccgccacgtggacacggcgagagcatcctggtcgtcgaggatgaaccggcgctcgccgcgagcgttgctcgtattctcacccacggcggatatcaggtccggtccgccgtcagtggccccgatgccctggctgcctacgcttgcggcggctgcgacctgctgatcgccgacgtggtcatgcccgacatgtcaggctcgcgcctggccgagatcctgcgtcgcaccgacccccgcctgcccgtgctctacatctccgggtacatcgacggcaacctcggccccaaccgtctgtgcaaaaccgacgctacggtgatcgagaagcccttcactgcggaccacctcctcaccgcggtcggcgacgcgctttcacgggcaccggaaagcagcggcatggcaggcgaatctccacagccggccgacaactacccgcatacgtcggcttgacctcaccgacagccgcaccacgcttctgctcgggtgttcgcgggccacgccggaacaggcgtgacccgcgaacggcgtgagatcagctgaccgatcgggcgccggaattcaccgggaacaccgccaccttcgcggagccgtcccggtggtggccgtcccagccgccgtgatcgcggtgccagccaccacggtcccagtcaccgccgtgccagctgtcgtaccagccgtggtaccagttgtcgtcgtcccagtcgccgttccagtcgtcggtggcgacctccaggacccaggcgccgcggttgaacccggaccacacccgcgagcagtcgtagtcatcccagcgaccgtggtactcgccgagccggccgacccgctcacacccgaaccgggtccggaaatatcccacgacgtcgctgtcgtcccagtggccgacggcctggaccgacccgccgtgcacggccggctgggccgtggcgtcgacggcctgtgcgggccccgcaccgatcaccagagcggcacccagccccaggccgcccacagcgagcacacgagtaatgctcttcattttcgcctccgatggctacatcagttctttcagcggcttgacaccgcgaaccgatcggatcacaggccggtaatccgggcgagaattcggatgcccttacgccattcggatgacgtaaagaaatgatccgacaatatgaaccgcatctgcggaataaaccgtttcgactatgccgccgctggccgaatggccatcctgaaggtcaaccgaacggccaggatcgccccattcgtcacccgcacgagatcaacttcagcagcgccggcctggcggaataaagccacagaacgtacatttcggacgagtgagcggtatccgcactctgcttctacgcaaccccatcgggaaggaacgaccagcatgctgaaggtcttggccaccggagccaccctgctcgcctcactggccggcaccggcacggccgcgcacgccgcgccgtccacgatcgtcccgggcgaggacatggccatcaccgtggccgccgccaacggcagcggctgcccggagcgcagcgcgaaggtcaccgtgtcgccggacaacaaggcattcaccgtcacctacagcaagttcacggcccagaccggccccgacgcggggcccaccgactttcgtaggaactgtcaactcgccttgaacgtgcacgtcccacagggttacaccttcgccatcgccggtgccgactaccgcggttatgcccacctcgagcgcggcgccaccggctcggaaagcgcgaactactacttccagggtgagccgcagtccacccgcatccggcacgacttctccggtccggccgacaccgactggcagcgcaccgacaccgtgggcatcgggtcgctgtcgttcctgccctgcggcgaggaccgctacctcaacgtcaacaccgagctgcgggtcaaccgcggctggtccagccgtaccgccaccagcttcctgaccatggactccaccgacgggcgcatcgacaccgtctaccacgtcgcctggaagaagtgctgaccgcataggagccgccggcccgggatgcctgcatcgcccgggccggcgacggagcaccgcgagcgttcttctcatgcgccgcaacagaacacgcctggtgcagtgccgacgaccgatgaccgccgtccggatgctgcccatggcgttgctgtggtgatgtcgtagcgtggcgtctcgtggcgaaaaggacaggcgcacagggacccgggcaacgccagtcccgggagctggcggtaccggcagtggtggacactcccggtgcccgagtgcagccggcgggcgggctggcgcagtggatgctcaagcatcgcgtgcagccggtgggcccggccgcgggtgaggcgcacgctgagcagcacgcctggtggaaggtgatgtgcctgaccggcgtcgactacttctccagcctcgcctacgtgccgggcatcgccgcggtggcggccggcgcaacctcgccattggcgaccctgctgatcgtcgcgctgaccctgttcgggatgctgccgatgtaccggcgggtcgccaaggagagcccacacggcgccgggtcggtgcacatgctggaggaactgctgccgttctggcgcggcaagctgttcgttctggtcctgctcggcttcgtcgccacgagttggctcatcacgatcaccctgtccgcggccgacgccagtctgcacctgctggagaacccgcactcccccgccgtactgcacgggcacggcgtcgcggtgactgtcgtgctgctgctgattctgggcggggtgttcctgctcggcttcagcgaggcggtcagcgtcgccatccccctggtcgcggtattcctcggcctcaacgccgtcatcatcggcgccggcctgatcgacatcgtcaccaacgcgtcggcctggtcggcgtggacgtcggcgctcacctccggcggcggcggattcaccgccctggccggcccggctctgctggccttcccgttgctggtgctcgggctgtccggtttcgagacgggggtgagcatgatgccactgatcgccgccgacggcgccgatcccgaacagcggctaacctcgcggatcggtaacagccgcaagctgctcaccgccgccgcgctgatcatgagcgtctacctgatggccagcagcttcgtcaccaccgtgctcatcccggccagcgaattcggcgacgggggaaacgccaagggccgcgctctggcgtggctggcccacgaacgcctgggcgaggcgttcggcaccgtctacgacatcagcaccgtgctgatcctgtggttcgccggcgcctccgcgatggccgggctggtcaacatcgtgccccgctacctgcccggctatggcatggctccggaatggggccgtgccgtgcggcccgtggtcatcgtctacaccgtgatcagcatcgcgatcaccatcgcgttcaaagccgacgtcgacgctcaggccggcgcctacgccaccggcatcctggccatgatggtgtccggcgcgttcgccgtcaccgtctcgaccatccgccaccgcaagcgtccggcagcggtcggcttcgcgctgctcaccggtgtgctgacctacgcgttggtcgcgaacatcatcgacaaacccgacggtatcgccatctccgcgatgttcatcgccggcatcatcaccatctcgttgatctcccgggtcgcccggaccaccgagctgcgcgccgaccgcatcgagttcgacgacaccgcccgccgattcatcaccgacaccatcgaccacgacgggcagatcaacctgatcgccaaccgccggcaggccgggaacgccgccgagtaccgggccaaggaacgcgaacaacgcggcaacaaccccgtgcccggcagcgccgacgtcatcttcctggagatcgacgtcatcgacccgtcggacttcagcgagaccctcgccgtgcacggcgtgcaggtcggcccgcaccgggtgctccgggcgcaggctccggccgggccgaacgccatcgcggcgatcctgctcgccctgcgcgacgtcaccggggtacgcccgcactgctacttcgcctgggccgagggcagcccgctggtgcacatgatccgctacttcctgctcggccgcggcgataccgccccggtcgtccgcgagatcatccgggagaacgaacccgacccggcccgccgacccggcatccacgtcggcgcatgacccgttcggcgacgctgaggatgcccagccgagtcgagggctcggcaacaagccggaaatgtttcgtttcacggcccggaggtattccgcaggcgtgagtaaagacgcaggtgtcgccgttgacgggcacgggttcgtagtggtcgccaaccggctgccggtcgacgaggtgaccgacaccgacgggcagcgccgatgggaacgcagtcccggagggctggtcagcgccctgcagccggtggtgcgccagcagggtggtgcctgggtgggctggaccggcagcgccgggaccgagaccgaacccttcgacgtcgacggcatgtacctgcggccggtgtcgctgagcgccgacgacgtcgaccgctactacgagggccagtccaacgccaccatctggccgctgttccacgatctggtcgaacaaccgactcaccgccgggaatggcgacaggcgtacgaggcggtgaaccgtcgcttcgcccaggccgccgcggacgtggccgcaccgaacgcgaccgtgtgggttcacgactaccagctgctcctggtgccggcgatgctgcgcgaactgcgccccgatgtgcggatcggcttcttcctgcacatcccctttcccccggtcgaactgttcatgcagctgccacgccgtcgtgagctgctgcgtgggctgctcggcgccgatctggtcggcttccagggcgccctcgcggcgcagaacttcctgcggctgactcggcagctgctgggactggatcccgaggacgaccgcgtcgaggtcgacggacgtaccgtcgtcgcccgggctttcccgatctccatcgacgtcgccgaggtcgaccaactcgctgccgaccccgcggtgcagcagcgggctcaggagctccgagcggaactcggcggtcaacggcgactgctgctcggcgttgaccgtctcgactacaccaaaggcatcgaacagcgcctcgaggcgtaccacgatctgctcgacgacggcgagatctccaacgacgacgtggtactggtgcaggtcgccacccccagcaggcaacgcatcacccaataccagcagctgcgcgaaagggtggagcgcgaggtcgggcgcaccaacggcgaatacggccacatcggccgcgtgccggtgcactatctgttccagtcctatgaccgcgctgaactcgtcgccctgtacctcgccgccgacgtcatgctggtcaccccgttacgcgatggcatgaacctcgtcgccaaggaatacgtcgccgcccgccgggacgagcagggagcactcgttctcagcgagttcaccggagcggccgaggaactcggcgacgcgttcctgaccaacgcccacgacaccgacgacgtcaaacgcgccatcctcgccgctctccacgctgaccccgaggacttgcgcacccggatgcgccggatgcgcgagcaggtgcgcgcctacgacatcgactactgggcccgggacttccttggtaccctcgcaccgtctgaggctcctcagctcgcaacagcgccatcggtgtagccggcgctctcggcttccgaatgaccgtaccgaagacttttcgcccctgaggcaacagatcgggtgacgaccgacgtctcaatagacgtcaacaccgatcaacagatgggcaaaaacagcatgcgtgagaacgacaaccggcagcagtcatccggactgaacgagatcagaactccggaatcgtccgcggtcggggagctctcccgtacgccgaagcggcgtcgtcgcgctgtgcagatggccggcggcgtcgccgtcggggccggtctgctcgtcggtctggtgggcatgccggcggccttcgcgtccgcgggatccaagccgccgcacgtcaacccgaccagcgatcccggcgatccggtcgccccgaactgtacgagcgccaagctgaagatcactatggatccggccgagggcgccaccggtcacagcatggcacgggtgcacttccgtaacaacggaaccacctgctggttcaggggctaccccagcgtcgtcgcgtacaccgcgtccggcgccaaggtgcccgtcgcgcagaccccgcggggcttcgccggcggccaggcaccgggttccgacgagatctcgccgctcctgctggagaagggcgacgtcgtgtcggccgtggtggaggcgctcaacgccggcaaggacggccgggcctgcacaccggtgaccaagctgaaggtcagcccgccgcaccagagccggtcggccaccgtcgcctggagcggcgggtgcgccgacttccaggtgcacccggccttccggggcaccaccggccaggagagctgagcgacaaccaccggatccggcagcggcctgggggttctcccggccgctgccggccgtccgctggtcgatcaccgacctggccgccaccgtccgctccgcactcgggtatcacgtgccgaggccgcgctgcggcctcgccgactgggcgggcagtgtcacagcacacgctcaattcggcccgccggataccgatcttttgacgtgcgactgtggtggacctggatgacgaccggcgccgtgttctgcgtcgcccttgccgttcttcctgccgactcggcgccgagccggctcatctattacatcatcggcgccgccacggtgacggcgatcctgaccgcggtccgccggtaccgtccggccgacgcccgctcgtggtacgtcctgacagccggcatcggtgccttcgtcgccggcgacgtgctgttcgaggcgatggtcgcggtgaccgggaaacatctgcacctctggtacaacgacggcctctacctgctgggctatcccgtcctctgggccggtctgctgctcgtcgcacgccatcgcgggcctcgtgatcgcgccggcgtgatcgacgccgcgatcatcgcgaccgcggtcggtctggtgtactgggtcttcctggtcgaaccgacgctaggcgaccgtagcaccccgctcgtggaacgtctggtgagcggcgcctatccgacgtgcgacgtgctcatgctcgccgtggtggtccgcatgctgagccggccgggtgggcgcaccccgagcgtggtcctcctcgccacgggcagcatgatcatgttcctcggtgaggtcttctggacgttctcgttgagcaccaacgcccacatcggcaccgtggtcaacgccggattcgttttcagctatgtgtgctgggccggcgcggccctacaccccacgatgccggcggtcgcgaccggcgggctcggcccggtccggttcgggtggggccgtctggccaccatcaccgccgcgacgctgctggtgccggcggtgctgttcgcccagggcctccggcaggaaccggtcgactggatcgccatcggagtggactcggtggtgctcttcctgcttgtcctgacccgcctgtccggcttcgtgcagcaggtacagcgacagtccgcccgcctcgaaaaactcgccttgcacgacgacctgaccggcctgatcaaccgccgaggtttcgagcaacggctcgtcacggcggttgccgccggctccgtccaggtctgcctgctcgacctggacgggttcaagagcatcaacgaccggctcggtcacgtggtgggcgaccgcctgctgagcctggtcgccgagcggctggcaaccgcgctgcccgacgctgacgcggtcgcccggatgggcggcgacgagttcgcggtccttgtacccggcgcgggtaccaccgaaggcgacgcgatcgtcgcacggctgaccggggcgttgcgcgaaccggtgcacgtcgacggccacgaactgctggtcagcggaagcatcggcatcgccgacgcgcaggacaccaccgatccggtggaggtgctgcgccgcgccgacctggcgatgtacgcggcgaaggcagccggggttcgcgcccggcgatacacgccggacctcgaccggcgggcgggcgaggaagcccggatcggcgccgagctgcgggtcgccctggacgagggccagttccacctgctttaccagccgatcgtcgatctgccggacggcgaactacgctacgtcgaggcgctgatccgctgggatcatccggagcggggaacggtgagcccggccgtcttcattccggtcgccgagcgcaacggtctgatcgtggaattgggcgagtggatcctccgcacctcctgccgacagttcatgctgtggcggcgcgagcaggctgcgggcgcgccggagaagatcagcgtcaacgtgtccgcccgtcaactggccgagccgaacttcgccggattggtcgccgacatcctcctgcaggccggaatgccggcgcatcacctgctcgtcgaggtcaccgagaccgcggtgttcgaaggcggggtcgccgtgaccaccctcgaggagctgcacgatctcggcgtccacatcgcgctggacgacttcggcaccgggcattcctccctgaccctgctgcacaccgtcccggtcgacgtactgaaggtcgacaagtcgttcgtcgaccacgtgaccatggccggtaggcacgcggtgatcgccaccgcgctcatccaggtggccaacggtttgggactgatcgccgtggcggagggcgtcgagaccgcggagcaggcggccgaactgcatcggctgggctatcgactggcccagggataccatttcggccgtccgtccgtggagccgctccgcggcgcggcagcagccgcccggtaagggacgtcggactttcggagggccgagaagtccgctccctcgtggcggcaaggggcgccgagcgttaccggatcatgctgcgacgcagcgactgcgcccgccgcacccggtccgtggtgaacggcagggcggtgcccgcccccacccggcggctcggtgatgcggcatcggtgtccaggcgcttcgccagcacccgcaggcggtggtcggtgggcgccacggcgatcgcgaagcgtccttcgcgcggcgtacgctcgtcgccgccccagcggagcagaccgtcgcactgcgcgacgatgtcatgaacaacgatcagctggtacggcaggaagccgtcccgtgcgcccgccggataccaccccggccggatgtcgaggacggtgcccgaagcgtcggtgacgagatcacccgagcgcagcgcgtcgatctcgtagtggaagcggcgagcagcgtagagcaggatcgtcgcggccggaccgggcagcaacgccaccgcgaggtcggtgccctgcacggcgtacgtacgcagagtgggtttggcagcggcctcggccgcggccgggggcagcccgggaacggtcagcatggctcccgctcccgccgacgccagcagggtacgtcgccgcatcaggacacctttcctcgacggatgtggatctgctccttctcggccagcgcgaccagccggtcggcgaagcccctgcagaactgccgcagctggtcgtccacggtcaccggggtggtgctcaggccgcgcagcagcgccgtgcggtatgccgtcaccacgtcgtcgccggtgccggtgagcaggctctgtgccgcggtcgcggcggcgttcgggtcgctgccgaaccggccgcggtagaaccggctgaaccggataccgcgatcggctccgcgcaggtgggcgccgagcgtggtgcccgcgcgcagggccgcggcggccaggtacgcgtccacgtccgcgaccagcccggcgaggtcgagcgccgccggcttctcgctggtggcaaggtacgccgcgcagtagtcgcgggccgcggtggccggagccgtgaaccgccatccgccgtagaaggcgatcaggtcaccgccccaacctccggcgtcgccccgtccgcgcagatcggcgagcgccgccgcaccccaccggctgacgtccacgtccaccccggcgaccgggtcgcggtaggtgcgcacgcgcgccagcccggtgctgtcgacgtagctgacgaatgcggcgttcgtgccgccggccagcttccgggtctgccagttgtcgtagcggccggcgcgcaggtattccaggacccgctcgcccggatcgccggtgccgaacgcgaccgcgagctcgtgcagccggtcgatccagtcgaggtaggcggacaggtcggtcgcggcggagccgaaagcgccctcccccgggtcggcgccggcccgctgcacgcacttgtcgatctccagggtgccgacgtccatcgtggagatctggtcgaaggcccagttggcgggcagtgggtaggtcacgttcccggtccagcccgaggtgatcccgctgacgaagctccagcgcgggaacgcctcggccgcgagccggctgcacacgttccgggcgccgtagacgccgtgcgagtaccggccaccgcgctgccgcaacccggcgtcgaccccgaggaagtacgggatcacccgctgcgtgacctcggtgtcggtcgcgtcgtagtcgacggcgaagtagacgaccgcccccgcggcgatgccgtgcccgaccgccacgtcgtgcgcggtgagcgcgtccgcgtaaccctgcccccagccgaagtaggaggccgagtccgcgtacgtctggaagatcgggaacaggcgcaggttgttggcggccagggtggccagctcaccgggcttgatcttcttgtcgaagccgctgccctcgacgttggtcagatagcggccgatcgtgcggtacccggccgccgccagggcctgggcgcgggccggggtcacctcgtcgacggtgtccgccgccgtgcccgggcgggcctgatcaccgatgctgatcagcaacgacgcccaggtcgcgaagtcaccctcgccgctcacggggagcccgcagaactgctgcaccgcgcgggcggcagcggccagcgactcgtcgaagtcgccggtgaacaccggggtggccgggtagtgcgtgagcgcggccgagaacaaccgcacccacgggccggaggaacccgccttgatcaggccgttcttcttgaccccggcctgggtcagcgggccgaagttgccgttggcctgcgcgtcggtcaggccgccctcgtactgcacggcgaagatcagcgcggtcaggaactcgcgggagcggcggccgtcgcaggccagcacggtgaacgccgaccggttcaggtagcgcccgttcagccactgctgggcggcgcgcagtggcgcggaggcgccggactccagcacgtagctgtcggtgaacagcagggccttgcacaccttcggggcgaccgccccgtcggcccgcgccgtgaggccggcgtcggtcatcagggccgtgacggcggcggtcacggccgtgccgtagatgccgtcgaggcggaaggcggcatagcccttgcagaccaggccaccctggacgatcttgaccaggttgcgattcgtctcggcgggtccgatcgggccgtgcgcggtcagcgccgccagcgtcgccgggccgaagttgtccgagagggccgtgatccccagctcgtgctgcagtccccgggtgagcgcggccatcgtctggcgtccggcgctgccgtcctcggtgaccaccacatatccggagaccccggcgtacgtggcgttgacccactgctgcactgccagtacggcggcgtccatcagcacctctgattcgtcgtcgtcactgcatggccggacgacacgatacaggccgctgcaaagcgggccattacgcctgctcacggccggggcgcaagcctgccggcggcgtaacccacaccgacggacgcatgaccggagatgatagcggcatggccgggagcggtaagctggcgaagcttcccctgatcttgctgccgggcgtcgcctgggtgctggaccggctcttcggcaactattcatggaaatttctggacagctatcagcgatggtcggcagccgaggaaaagggaggtcctccgcggacagaggaaggacattccgatttccttgtcgttcggctgctggcggcgatctgcttcattgtcgccatcggcctgatgctgggcgccttattgataaacccggcagatacggcattcaagaaaatatcgcttttcttgtgcatttttagcagcgcctgggcgatgatgacgtcatttgtcgaatcgctcacccaccacggtgcgcgattgctgctcgtcactcatcaccggatcacctccacaatatggctcttgttactggcgacagccgcgatcatctgttacctcgccttggtgtcttgatggtgagctctgccgccaccgtcggcggcgacagccggggctatgaggccggcaagaagatcaataagcgtttccccctgacttcgcctcaaccaacggtggtcccgggatggtctgcgggacgaggtgaggcggcaggggtcgcgcggccggggacgtttgcgctgcatatctaggctgccaagccatgatcgagaaggtgcgtacggcggtactggccgttgtcgcgttcggtggtgccgggctctgggcgtacggcatggcggtgttgcagccgttgtgtgaacctggctcgccgtggtgggacgacaagacagacctgtcgtatggggcgcgggatgtgcgctggggagccgccctcgcttgctgcctggcgcttgtcgtgctcgctcgtggtgctcggtcggcggttgcggtcgccggggtcggcgtcgtcgtctgggccggtgtcgaccttgtgctcgatcgggccgacgtgggcggctcggcgctgctgcccctgctgtcggttgccggagctgtggttgcagcggcggctgtgggctgccggcgggccggtcgggccatggtgtcgccggatcggcacgttttcggagtggtcgcggcgatcgccatcccggtcgggctggcggtcagtttcgtgacgtctggccgcaatgccgagccggagctggtgtgggccgtgctccccgtggtcgccttgcacgctggtgtgggattggtggtcgcgctggagacggcgacaccattcacccgagcgcgcgccatggcggtcaccgtggccgcagtgatctgggtcgtggcgctggccattcgtgcggtgacgacggagaacatgttggcgtggctgtgggtggaagcggcggtgtcaggcctgctgctcaccgggatctggtggctgggcaggtcgcaggcaaccccgtgggaaaggacgggcatgactttcgccggtggactcatgacgccggccctcttctttggtctgctcttcgcgacctcggtgttcgacctgctgtcgccgctgaccaggtgggccggaagtgtgccaggtattgatggggacgtgtcctggacgactgccggactgttgacggggctctcgctggctttcggggcgctcacgaccaggtcggacggttcccggcgaacggcaccgccggcttcgacagcaaccgggccgcaccacgcccgggccggcactcgggccaccgcgccgaccagaacctgaaggcgcacggtccggccggtcgttgtccccgcgatgaccgccggcgacggaccgaagccacctggccgcccagtgaccggcacgacctgcggacagcgactaccgagtggcaaccggagcactccggcgcaactccgcccgcccgctggaatggacggatgaccggtacccggcttccttcccctgctcaccgggttcgcccgtccctatcgatgtggcgtcagcgatgagcgcggcagtcgacgccggcccgcagacccatcgcccgtcggtggccgggctggagatgctcgaggagctgggtcgtggcacccacgcctcggtctaccgggtgcagcgtgacggccgtgagtacgcgctcaagatggtgcacgccgacgtcctggaccgcgctggtgccaccgcggctttccggcgcgaggccgcgctgctggcctgcgtcgatcatccctcggtgggccgggtgtacgacgtcggcgagaccgacgggacgcccttcctgatcatggaactcgtgcaggggatgtcactggcggcgctgcgggaccagcgcccggtctccgtggtcgaggcggtggccatcaccgctgagctggcggccgcgctcgccgccgcccatcgggtcggtatcgtgcaccgcgacgtcacgccgcggaacatcatcgtgctccccgacgggcggccgaaactcgtcgacttcgggctggccgcccggcaggaccacagtgtcggccactccgccgccggtacgttcgcctacgccgcaccggaacagaccgggatgctggcccgcccggtcgacggccgcgccgacctctacgccctcggtgtcgtgcttttcgaatgtctcaccgggcgcgcaccgttcgcctcgaccgacgtcgccgagctggtgcggatgcacgccgtggaacccgcacccgcggtgcgtgatctgaatcccgaggtgccggtcgccctggccgccgtggtggcccggctgctcgccaaggaccccgacgaccggtatgccgacggcgacgacgtcgcggccgtgctgcgcggcctggtcgacaactcggcggaggaacggcgagtcgagggcaccgggggccggctggtgggccgcgagaccgaactcgccgaactgacgcgccactgggccggggccggtacgggccgcgcgggagcggtgcgactggccggtgtgcccggcgcgggcaagacccggctcgccggcgaactggcgcggcgtgcccgagccgccggccaccccgtgctgaccctgctctgcgcgcccggcgcaccggcgatggcgccgctgcgggccgcgctcgaacgctacctggaccaggtcgacaggcttccggcggccgcggccgaggaagcgcggcagcgccttcgcaccatggccggggacggcgccgccgtacttcaattgctgtcgcccgcgctgcggcacatcctgcgggcgccgcaactggccgacgaggaccgtcaggaccagttggtcacggcgaccgtggcgtttctgaaccggatcggtcacgccgcgaagggcctgctcgtacacgtcgacgatgtccagtgggcggacgacgccaccagccgggtgctcaccgctctgagcgcttcgtcggcgccggtgctgatcgtgagcaccgaacgcaccggtgaggccgcctgggcgcccgaggtgccgatcatcgaggtgccgccgatggacgaggccgagatggccgccctcatggcgcaccatctcggcaacgccgccgtgccgtcgtcgctggttgagcagatcctggcgcgcagtgagggaaacccgttcgccgcgctgcagtacctcaacgccatgctggacgccggggtgctgctcccgcagtggggctcgtggcggctcgaccagtacggcctggaccggctggacctgcccaccgacgtcctcgatctcgtggtggcccgtaccagggcgctgcccgagacgaaccggcggctgctcgtggcggcggccgcggtgggcgctccgttcaccgccgcgctgctggccgaagtctgtgacaccggcctgccggcggcgctggaggcggtgcaggacggggtggcccgcggcatcctcgagccggcgggcggggggcggcacgccttcctgcaccagcggttgcgtgaggcgctgctcagcgacgtcgacgccgccgggcgacgagtcctgcacaggctcatcgccgagcacctcgacgccgctgacaccggggattcgcgggaccggtaccggatcgcccgccactacaccgcggcaggcccggaggcggatccgctgcgtacgctggctgcctgccgggccgccgcggatgccgcactgaccaaccacgccgcggctcaggcactggagttcctcgatctggccgagcaggccgccacggacgccggcgtgccgctcgacgggctgttccaccgccagcgcggcgtggccagcctccgcgccgggcacctggccgccgccgagcgtgaactcgccgccgctctggagcatgaatccgacccgttgcgccgggccgatctactcgccaagatcgcgcacgcccagcacagtgacttcgccgccaccgaggcgctgcggacggtccgggccggtttgcgcgaactcgggcagcccgtgccgtccagcgtgctgctccaggtgatcaccggtctggcctacctgctggtgggatggtccactggccggcgacggcaccggtactccgggcgtgacgaagcagcccggcagcgggatcgcgtcgtgtcggatctgtgcgacgcgggggcgatggcggctgcggtcggcatgcacatgatgctgatccccctcttccacttccgcgccctgccggccgtccaccgtctcggcccgggccccgaatacgcccgcgtgcaggccgccctcgccatgatcgcggatgccgtgcgcctgtcccggctcgccgagcgctgctacgcgcgcgccgaccgggcggcccgcgccgtcggtgacccccggctgaccacccgggtgccgtggagccgcgccaccggaacggacgcggtggccggtttcgggccggccaccggctcggcgatccgcgagatgctgcgcgaacacggcacgtggctgccgcccggcgaatatctgtccggtgtcggcgcgctggccggcacgctgctgctgcgcggttacacccgcgaggcgcaggcctggtacgaccggggccgggaccgcctcgccaaggacctcgtgctgccgggcaacccgatcgccgcggtgggtgtgcaggtcgccgcgatgtccggcaaccgggccgaggcccaggcacgcctgggcgggatgctggccgccgccgggggtcgcggggacgaccagggccggcgaatgaacatcatgatggcgcgggcctgcatggccgccgagttcccggacacgcaggacatcgacgcgctcaccgcggaggtgcgccggtggcgcatcacgccccggcgggtctggccgcagcagcgcaacttctggctctacctggcctgggccgaactggcccggtgccgcagcgccgaaccgcaggagcgggcggcccggctccggctcgcccgtgacgccgtagccgcgttcgggcgcgccgccgacaacgacgtgctgcgcgccttccaccacgccgtgctcgccgactacctcgagctgaccggcgcggcggaaaaggcgctgacccagctgagtcacgccgaccggctgggctgcgggatggatctgccgctgctggctcacctcgtcgcggtgggccggtgccgggcgctgcgggcactcgaccgccgagcggacgcggaccggcaagccgaactggccgtcgcgatcgccgtcgaccacgggtgggagcaccgcgccagggccgggcacgcgctcctggagcggtcaggctcccatcgcaccacggtcagccgccggcagccggccgacgtcaccggtgagctgttgcgccgccggctgcacgcggtgcaggaactcagcgccgcggcggccaccgtgctggatcccggcgagctcgcccgcgtcgcgctcgacgagacgatgcgaaccttcgccgcggagcgggcgatcctgttcctcgccggcgacgccggcggaccgctgacgccgtatctggggcgcggggccggcggtaccgatctcgtcgaggtcaccggttacgcggccagcctggtgtgccaggtccatcacaccggctccgccgtcgtcctgaccggcaccgatgacggcaccgccgtgcgttcgcagagtgtggtggccaacggcctgcgcagcgtgatgatcgcgccgttggtgtcacgcggtgacgtcatgggtgctgtgtacctggacacccggctggcccaaggcgcgttcagcgaggacgacgccgacctgctcaacgtgatcacccagcagatctccgcctcgctggtaaccgcccgtgccgcgcagttggaggtgaacgtgcgcacggccgaacgccagcgggccgtcgccgacatgatgcgggcggcggtcagcgatctggccggcaccctggtgcccgacgaggcgctcgcccggctgctgaccaccttcgtccgggtcaccggcgcggacgcggggatcctgatcccgctgaccgggtcggccgcggccgtggcaggtgcggtcgatgccacgctgctgcccggcttcgccgcgctcgacgcggtacgccgcggcgccgcggacggcctgtgggcagaaatcgacgcggtgacaccgggtgcccaggcctgggtggcggcgcccctggccggccgggacggacggatcgcggtggccgtgctcaccgctcgtgagccgggccggttcgacgacagccacgtcagcgtcgtggcggcgctggccgagcaggggatggtggcgtacgagaacgcccagctgttcaccgaggtccgccggctggccaccacggacgcgctgaccgggatccacaaccgccggcacttcttcgaaggcgcctccgaacggtgcgcgcaagcccgtcgtaccggcactccgctgagcgcgttgatgatcgacatcgaccacttcaagcggatcaacgatgacagcggtcacggagcgggcgacgacgtcatccaagccgtcgcgggccgcctgcgtgacgtcctgggtggccaggggctgctgggtcgttacggcggcgaggagttcgcctgcgcgttgcccggccgttcactcgccgacaccgcgcacctcgccgaggcgatgcgcgccgccgtcgccggcgagcccgtggtcacgcgcagcgggccgatcccggtgacggtgagcatcggcctcgccgaactcggtgaggggacgccgaacctcgacgacgtgctgggctccgcggacgcggcgctgtacgaagccaagcgcggcgggcgcaaccgggtggcacaccacatgggctgatggcgggcgatggtggtgggtgcggccgccgatgccgcgacgacgggtcggacgaactcgtccggcccgcgaccggcgaatccgcccggccgggtacgagcgctgagctgatacctccccgcccgcacccgtatgccggaatgctgatcccatgacccagatcaagcgaccgcgcaccggggtcaccttcctggcggagtgtggttggtacctgtccaccggtacagcgctggtcgcgggatacttcctgctggccctcgtgccgggctccggtctcctgcggctggtggcatacgcgaccgtcgtgctgtccgtacccgtggccgtgaccatcggcgtgcgtcggcacggatgtcaccgaccgctgcgctggtatctggcggccgcgggacagggcacgtacggaatcggcgatgtgatcttctacctgcaccgtttcgtcgtcgatgtcgacacggacctggcttccagcctgtgttacctgctctcctacccgttgatggcggcgggtctgctggggttcatccgacgccgtgcggccgggcgggatgtcgcgagtctcatcgacacggcgatcgtggggttgggcgcggggctggtgatgtgggtgtacctgctcgcgccggggctcgccgatgccacccgttcgtcggccgtgaagaccaccgtcctggcctccgcggtgatggacctggtgctgggcatcctcgcgatccggttggccctcggcgacatccgcgtcgtacccgcgtaccggctgctgctgctctggatcggtggcctggtcaccgcggatctgacctacggctatctgcagctgaccggcggctaccgggccggggatgtcctggacctgctgtggttggcctcggccctggccctgggcgccgccgcactgcacccgagcatgcggtcgctggaccggtccccggccgcaccggaacagccgatcagcaccggccggttggctgcgctcgcgttgacatgtctcaccgcgccggccctgctgtatctggaatacctccagcgcgcgccgctgcacgtaccgctgatcgccgcggccagcgccgggctgttcctgctcgctctcgcccggatgaaggtcatcgccgacgggcagcgtcgcgcggccatcaccgaccccctgaccggcctgcgtacgcggcgcttcctgcgcgaggcgatgcaccgccacgccggccccgacacctggctgctcctgctcgatctggaccatttcaaagagatcaacgaccggtatgggcacaccgccggcgacgacgtgcttcgcgaggtgtcgcagcggctgctggcggcacggcgccgcggtgacgtcgtcgcccggtacggcggcgaggagttcgcgatcctgctgccgaagacgacggtcgtcgagatcgcagcgatggccgagcagatccggcagagcgtggccggcgccccgatcgcaacgaccgggcactcgctccgggtcaccgcctcgatcggcggggcgacgtgggatgacgggcacagcctcgacgagttgatcgccgaggccgaccacgcgctgtacgccgcgaagcgggccggtcgcaaccgggtcatgatcgccccgaatcccgcaccccggccaccgaccaccccggccgaagcactgaaggaccggccggcggcgtgaccggtcgcctcccgaaccccggcccgatgtgtcgtggcggatcgcctcggcgcggggaggacgtccggatgagcgcgaccttgatgccggtcccctgtccgccaccggtcaaccgatccggttcggggacccggtgcccgctgaggctgcatcggcgcgacggatgagcagggctcgctcacggtcattgcgggccagcgatgccgcccggcggaattccgccgcggcttcgtcagggcggccgagcttctccagcaggtcgccgcggaccgagggtaggaggtgatagtcggccatcgcgggaatctccgcgacctggtcgacgagttgcaggccgatctcggggccgtaggccatgccgagcgcgacggcccggttgagctcgaccactgccgagcccgtgacgcgggccagccgctcgtacagcgcagcgatgctcggccagtcggtcgacgggaccgatgccgcgcgggcgtgctcagccgcgatcgcggcctgaaggaagtaggggccgtcaccgcccagggcccgcgcggcttcgagggccgtactgccgcgttcgatggcggcgcggtcccatgcggatcggtcctgatcgttgagcagtacgacctcgcccgccgcgttctgccgggccgccaggcgggaggactgcaactcgacgagggcgagcagaccgtgcacctcgggctctcggggcaacacggaagccagcacggcggccacccggacggcctcgcggcacagggcgggccgcgtccattccacgccggcggtcacggcgtacccctcgttgaagagcaggtagatcgccgacatcaccgagccgagccggccggctcgctccatcgcatccggctcttcgagcgcggcgccggccgcggcgagggtccgcttggcccgggagatgcgggtggcgaccgtcgcctcggaggtgaggtaggcgcgggcgatctctcgcgtggtgagcccggcgaccatccggagggtcagcaccgtgcgggtgtcagcggtgagcgacggatggcagcagatgaacatcagccggagtacgtcgtcctcaagatggtcgacggtgaacttctgttcgtacccctcgaccacgcccacggccacctccgcgtacgcccggacctggcgctcaccggcgcggaactggtcgatcgcgcgtcgtttggccgtggtcatcagccaggcggcgggattgtccgggacgcccgtccgcggccactgcgcgagcgcctgggcgagcgcctcctgagccaggtcttccgcgcggccgacgtcgcgggtgatccgcagcagcgcgccgagcaggcgcgacgactcctgtcgccacacctgctcgacggtgcccgcaggatcggtcacccagccatctccatgatggcgcggacctcgacccacccctcccagccgggccaggtggtgcggtgggcgtcgaggaacgcctcagccttgcgggcagcctcggccacgtcgggcagctcgtagaccgagtacccgccgacgagctcggtggcctcgacgaacgggccgtcggtggtggcgatcacggacccggcgagggtgacgaccgcgccggcctgaatcggcatcagcccgcccacctcgatcagggtgccggccgccgactcctgggcgccgagcgcgccgatcgccgcgaacagctccgcgggcggctggccgctcgggcgggtggtctcatggacgagcagcatgaacttcacggtggatctccttgtgggtcgagtgctatcagaacagacgccgagcccgctcgtcacagggccacaggccggcccagacgagcaccccggtgacgatcgcgaatgcggtgttgaaggcgggctggcccatgacgaggttcacggccgtcgcaccaccgaggtagccggtcagcaggatcgcgccgaggacgcgggtgcgcggcacgtggaaggcgaccaggcacaccgccagcaccgtgccgcagacgaccgggaaccaaccgggggcgccgatcctgctgttgaagtccacgacatgcttctcgcggaccagatgggtgatcgagtcgaaggccaggaacagggtgacgagcccggtgacgatccagcccgcgatgcgggtggagccgccacgactggtcatttccgacgcgatggtcgccgtctcagggtcaatgagtgccgtcatgcccctacgtcgccgggcctgccgtcatctcgacatcacacctcaacttttttccgagggcgggtgagagcacgccctgtccggcacctgacctcgatcatcaacttttgttgacggcgatctcgctatcaactaaagttgatgacatggtcgagctcccttcacccgaggatccggacgccgcactggccgccgtcgtggcgctgcgacggctcgccaaccagttggagcgctccgcggtcgagcacgcgctgcgacaagggtggacgtgggcccacatcggccaggcactcggcatcagcgcccaggccgcccacaagaagctcgccccgaagatcgcacaggagagagacgccacgtgaagcttccccgccccatccaggacatgcgcacgatcaagaagctgctcaccgccgcggagtccgaggcgcggcgcgccggtgacgaactgcccggcccggagcacctcctgctggccgcgttcgacctgcccgacgacacggcccggcgagcgttcgagcgggccggcgccgacccggccgggttccgggcggcgatcgacgacacgcaccagcgggcgatgcacgacgtcggcgtgcaggtcgccggaccggaccggccgcttcccgaggccgccccggccaccgggccctatcggctgaccgcgcccggccaggaggtcttccaggccgcggtgcggctggcgaaggccggctcagggtcacctctgcgcggtgcgcatgtcgtcgccgcgatcggcggacagcaacgcggcaccgtggcccgggcgctgcgcacgctcggcgtcgaacgcgccgcgctgaccgccgccgccgaccaggtcctcaccgagcggtgagttcgcccccaccgccgtcgaccgcccggggcatgccctgtctgcggctgcccatgagtgcgcagcgcgtgccggcgaacggtatagcctgagtgccgccctcgaccgctgcctccggaggagcaatgctcggttccgccgcgcccatcgccttccttccctcgaccgacctcgaacggtcgcggcgcttcttcgccgacacgctcggtcttgtggttgcagaggtgacgccgttcgcctgcgtcgtccgggtcgggacaacgatgctgcgggtcaccaagactgatcagctgcaaccgcagccgttcaccgtgttcggctgggaggttgcggatatcgacgcggtggtggccggcctgagtggcgcgggcatcacgttcgtccgttatgacggtctggagcaggacggtgccggcgtatggacgacgcccggaggcgaccgcatcgcctggtttcgggatccggatggcaacaccctgtccctgacgcagttcctccctcactgatcagtccggacgaggctcggcataccaaggtgccgcctcgctgccgggcagtcagcgcgagccggttgtgcgttcagacccgggtgctcttgctgcgggacggtgtgctctcattgagcctcatgagtgaggcacgcgcagtcgaggatctttgcgaggagttgcgccgacgggccggcacggccagccgcgtggatctctgggttcccgaggaactgacgatcggcaacgcgcctgagccgaagaacccgaccggtctcggcatggcgctcatcgtcgacaccgcgctgtcgctgggtctcatgccggacggattcactcagggtgccggcgggcgaacctaccactacaagtccgagtaacgcggttagatgacgctggcagcggtgcatagaccgcgagagtccagccatagcaacgcactagtctcgacccgtggacgacagcctccttcgccggctgcgggccgaacaggctcgggcacttctctacgacaccgagccccatcacgcggtgatgctggcctgcgacctgctggcggccggcgtcgacggcgacgccgtggtggcgctcgcggcgcagtcagctcgaacgctgtcgacgcatgacgctaaccagcacctggcggcggtcaccgccgaactaggcctcgcagaaccggacctggcgaccgcggtggagctgatcgcagccgacacctgcgagcgcatcctcgaccgcagcatcgccgccggagtgggaacccaccgtctatacgtggtgggccatgagcgcagcccactgtccgacctgctcccggcggtcgccgcactggccgagcgcctggaggacgaactcggtggacgcgccgacaacgacctgcaagcccgactcgacgcgctggcccggaccgtcctgaaccgcctgttgcccgcgtgagcatcgcatctgaaggggccggggacggggacggggtgatggaacgtttggccgccgctgttcgggccggcgatatccagcggttgaccgtgctgctgcgggagctgtccgacattgacctgggtggcgagctcggcagcgccctgttccgggaggcggccgtcgccgggcgggccgaggtggtcgaggaactgctgttggccggcgtggacccgaaccgggcatggccgggcagggtcgagccggtgagctggttcgccgagcgtggggcctggaacatgctggtcacggtgttgatgcacaaccatgggcactcgtcgtggccgacagtccccgagtcctcgttgcgagcggcactcgctctggcccgcacctggcttacggtcgacccggaacaggagctgcgccggcgtctcggcgccctggacgaccccgcgaccgtggtggagcgcgagcgggtacccgcgtggcgcgacggcgacgacggcccgtcggcggtacggatccgcgtgcacaccgccgacggccgcgaggaccgggtgtgggtggcgcatcgcgcggtcgtcacgctgctggaggacgcattgggcatcgtcacgtcgaacgatgagatcgccgcgcgtgccgtgcacaccgcgcacccctactcgtgggacaacgcgcaggctcacaccacgatcagggagcgcgcggaacgcgatgccgcggtgttcgactggctcgccgcccgattgacccatcccaccgtcgaacaccggcggttcgcggccgaggtcgtgcaggggctgtgtcggcgcgagcggccgttcgacgacgcgcaggccgcggacatcatcgccgcccggatccgtgacgagcgggacccggtcgtgctcgacaacctgatcggcgccttcgccgagttcgccttccacgcccggcccggtaccgacctgcgtcagatcctgccgcacgctcggcaccgcgatccgctggtccgcacccgggtggccatggagctggtcctcgtcaccggttcgcggcgtgacgagacgctgcccgccccggcgagttctccacctgccgcgcacatcaggacgttgatcgaactcgcggcggacccggacccccacacccgtgcgacggcactgggcgtcctcgccggttcctacctcgacaccacacaggtccgcaccgtcttcatcgaccatttgagcgacccgcacgcacccgcccgcgtcccggctgccgccggcctctcactacgcgacgacgtacgcgggcaagatgccctgcatctcctgcgcaccgacccggtcaccgcggacgtagcgtgcgggtggctcgccgatctcgaccgcatcctggcccggcgtccggcgccgcagcactgaccggagccggcgaacgcgcgaccatcggctattcggtgatgctttcccgaacggcacggcgacagcgtcagcgccttctcggcggtggatcagaggtcgtccaggagggagagcacccggtcaggaccgtcactcgcggtccggtggtgagcgagcgcgtgggctgcaccggcggagctcggtcttccagatgcggcgtcgcgcaggttgtggggagggttggcgcgcgaccacgaccacctgatcccatcgctgtacggcgatgtagcagccgacttctgagcagccgcacgtcagcgtgaggggcccgcgggtcggaggctgttcggcggcgtcagagggcgtgggcgggccggcggtgacgcgtccagaagatcaccagcgggatggccgtcgccaggaccggggcgataacgggtgcccatgcttcgtaccggctgtactggaccacgatggtgaacaaaaggtacaacatcagggcctgggtgacgtagcccgcggtgtgcggtttggaccggccagcgggggctctgcgaagctgtacggcatagatgcctgacagcacgagcgcgcctgtcatgatccacagaccgagcccggagtagaggtatcccggtccgacgtaggtgcccgctaccgacactaagcggccctgggacagtccgaccgtcacccgggcaccctcgcgcaccttgtctacctcgatccaattcgcagcttcgggtgttgtccgctccgtgccgttgtccaggcgcagcgtgatctgctgacctgtcccgtgcgtgctgccgtcgaagacgtcgtagtagtgcgcgctcagtacggtcgcgtcgtgcgtctccaggcgcccggcgtcgaagtcggcgtggcatgtgacccgtacgtagacggggtaggtgacgagtagcagcaggccgagacacaaacccgccgagtatttcagaacggtccggtagaaactcttgtcctcgtcctgaccatccacagtgtccacgaacccaccgtatgtgcatgggtgtgcacgcgccacagctgcctccggcacctgcaggggccgtagtccgggatgatcagcgtcccgtccctcagacgaccggtcaggccgccgccgctatccggcgggcggggagttccgcggccggtttaccgaagtggtagccctgcgccagccggtagcccagccggtacagttccgcggcctgttccgcggtctcgacgccttcggccacggcgctgagccccaggccgtcgctgaccctgatcagcgcctcggcgatcaccgcgtgccgccccgccatggtcacgttgtcgacgaaggacttgtcgaccttgaggacgtccaccgggacggtctgcagcaggcccagcgacgagtgcccggtgccgaagtcgtccagcgcgattcccacgcccagcgtgtgcaggtcctcgatggcctggacggcgacaccgccgccgaacacggcggtctcggtgacctcgacgatcaggcagccggcgggcattcccgtctcggccagtacggaggcgaccatcgcggcgagccccggctcggcgagctgccgggcggagacgttcacgctgatccgctgcggggcggtggccggctgctcggcgtgccaccgggcgaagtcggcgcacgcggtccgcatgatccattcgccgagctcgacgatcagcccgttctcctcggtgaccgggacgaacgcggcgggactgacgaagccgcggtccgggtgctgccagcggaccagcgcctccacgtagcgcaggtcgccggagggcagcgccacgatcggctggtagaccaggcggaactggccggcgtccagggcggcgcgcagttcggcgccgaggcgggccttctcgtcggcgtgttcgtcgagtcccgccgcgtaccggcgccaccggccgccaccggacttcgccgcgtacatcgcgacgtcggcccggcgcagcacctccatcgcgtcgccggcaccggccccgtcggcgacgccgacgctcgcgaccaccagcagcttctgcccggccaccgcgaacggctcgcgcagcgcgacggagatccggtcggcttcggcgtcggcctgctcggccgtcgcgtcggcgagcaggacggcgaactcgtcgccgcccatcctcgccaccagatcgacctcgcccagcccgtggcgcaggcggtcggcgacggcgagcagcagcgcgtcgccggccgcgtgcccgagccggtcgttgatctccttgaagcggttgaggtccaggaggcagacctgcggggagccggccgcgagggcctcgcccagacgtcggccgaatcggcggcggttggccagcccggtgaggtcgtcgcgcatggccagccgttcgaggagcgaagactgggtctggatctgccggacgaagccggtcatccgggcggtcaccaggagcaggaccaggacggcgccgagcccgatggccgcccatctgatctcgtcgtgacgcaggccctggatcatcagcacggcgggtacgagcagggcgcagccgatcagcatggtggagcggccccacccgaagcggacgctggtggccgggcgtgccgcggcgccggcgtccgccatcgacgggtgcagcgcggcaccggcccagcagacgtagctgcccaggaacacggcggtgatgaccgaggccggacgtccggtcagcgtcggcgcgagactccaggcgaggtcaccggcgaagttcagcaccgagccggccgcgagcagcgccacgctggtggtgcgggctccggtgcgggtgagcagccgggtcgccaccgcacacatgatcacgtcacagccggggtaggcgaccgtgaggacccgctcggacagcggcgtgccgtgtccgcccagcgccgggtcgatcaggaacacccagtagaccagcgcgacaccggtggccatcaccgcggcgtcggtcatgccgggcaggtcccgccgggccggtacgccggcggcgaggagcagaccggaccagagcagggggtacgcgacgaggtagcacgcgtcgttccagtacgggtacgggtgctcgccgtggagcaggccaccgacctcgaaggccacgtcaccggccacgaacgcgatgacgccggcggcgaacacgtaccaggcgtacggccgggccggccggtaccggcgcaccgcggcgaggatggccacgaacgcggccaggccgatcccgttgtacagcacggacgcgagcagtcccccggccggcagcagcgggaagcccaggcagatcagcgtccccgcggtcatccacgtccaggtcagccgggtccggcggtcggtgagcgtcggcatgtcaggcagcggccacgacatcgtcgctcaccacccggtcacggccggcggccttggcccggtacagcgcctggtcggcgcggccgaggagctcgtcgccgctctccacgccgtcccaggtcgccacgccggccgagaacgtgcagcccatcggcgtgaccgggcgcagccggtcgagcaggtcgagggcctcggctgcggtggtgccgggcagcagggccacgaactcctcgccgccgtagcgggccagcacgtccgtcgaacgcaggttcgtcgaccaggccgcggtcgcctcggtgagcagtcggtcgcccgtctggtggccgtgcgtgtcgttgaagaccttgaagtggtcgaggtcgagcacggcgagggtgagcggggcgcggtgccgggcggcgtgttgcagcgccgcgggcagtgcggcgttccaggcgcggcggttgggcaggttggtgagcgggtccagctgggccgcctcgcgcagcagatcggcgtgttcggcgaggatggccgactgtgcctggacctgccggacgagcatcgtcatccgggcgatgacgagcaggaacatgaccaccgaaccggtcacgatcgcgtacgcgtcgaggacccggccggcaccgcggtacgcctgccaggccagcagcgccggcgcgatcagcgtggccgcggtgagcagcatcaggcggtgcagggtcatcggtcggacccgctgtgggccggccggccggccgatctccaccatgcccgggtgcaacgcggcggcgccgaaggcgatgtagccggtcaggtacgtgcagtcgatcagtcggccgccgagcgtgcccgggtcgtaggaggtctgattggcgaacgcccagaagtagtcgccgacgaggaagaccaccatgttcgtcgcgaccaggaagaacgcgatgttgcgcgccccgtcggcggtcagcagccaggcgaccatggcgaccagcagcagatcgagagccgggtacgagatcgccatcagccggccggccaggccgagcgacgcctccgcggccgccggcttcatcaggaaaacccagctcagcagcgcgaacgcacttgtgatgatcatcgagtcgacgagcgtggcccagtcccggccggcgcctcgccggcgcagcaggaccagcaccccggtcacctggagcgcgtagcccagcaggtacgggacgtcgtacgggtggaagaccccaccgctgccggaggcgacgaagtagatgatgtcgcccacgacgttggccagctgcccggccatgagcagccaccaggcggccgctcccgcgggccggttgcgccggatgccgaccacgatggccacggcaccggccaccgccacgccgtcccaccccaggaccccgtacacgttgtcgggcagccacagatacagcgcgacgaaaagcatgccgccgatcaggaaacccatccacgcgcgaggacgcttcatcatctgtgccgcctcctcccgtactaatgtctgacgcttccccatgtcagtcggcgcggccgcagcggacctgaggcaatcggccgccggcggggcccgatccgcctcaggacacgcatcccggctcggtaccgtcggcgatctcctgattctcgaatccccaggcgcgcaggatccgggcgatggtgccggagctgcgcagcttcgcggccgcggcggtgtaggcgtcgagcaggtcgggggcgccgggatgaaaggccatggcgccgagttcgaggcggggtgtgccgtcgacgatcggcgtgaagctgggcgtgatgtcgagcgcgccgggtgcggtggtggccacgagccggcgcacggacaggctggtcagggcgaaggcgtcgatgtcgccggcgatcaccgcggtggtgagctggtcggagccggtgaacgggatgatccgttcctccggtacgccggccgcggtggcgtattcggtctcgaccgcaccggccagaaccccgagcctggtgccggggcgcgcggcgatgccggcgtagtcggccaggtgcagcgggtttccaccgcggacggcgagcgcctggggcagccggaagtcgggacgggcgaacgccacccgtgcgcagcgagctgtggtgatggacatgccggcggcgacgatgtcggcgttgccggacagtacggcgtcgatgagactggtgaaatccatcaccagcggttcgatccgggggacgcccatcgcggcgagaacctccctggcgatctgcggcatggcgccggtgagttcgccgccggcgtccacgaagccgaacggctcctcaccggcgacggccaggcgcgccactcgcgtccggcgcagtttggccagcgtgtcgcggggggtggacttctcggggtgcgggcagccggtcagcagcgcagcggacacgaccgctgtggtggcgaggatccgacgtcgggtcatcggtgccggcggcgcggcgtcggggtgcggctcacggggcatcggcgagtgcctccgcgacggtgcgggtcaggtcggcggcggggaacggtttggccagcagggtggtgtgggcgggaacctgcccctggtcggtgagctcgccgtcggagtatcccgacatgaagacggtgggcaggtcggggtcgaccttggcgatggtgcgggccagttcggggccgctcatgccgggcagcatgacatcggtgagcaggatggagatcgtggcccgttgttcggtgtagcgtttctcggcctcctcggcggtgccgcacgccagtacgcggtagccgtggcgctgcaggatgcgctgggccagttgccggacctgcgggtcgtcctcgaccagcaggacggtctggttctcggctgccggtggcgctgtggcggccgccggctcggcggcgggatcggacggcggggcgtcgtgacgatggagggcgatcgtgaaggtcgttccctgcccgggccggctctcgacggcgaggtgaccgccggcaccgtcgacgatggcgtgcacggtggccagcccgagaccggtgccgccgtggtcgcgtttggtggagaagaacgggtcgaagacccgggcgagggtctcgtcgtccatcccggcgccggtgtcggcgacactgatccgtacggtgtcgccggcgtcgacggtgaccgtgatccggccgccggccggggtggcatcgcgggcgttggtgaccagattgaccagtatctgctcgagcgcggtgggctcgattgcggcgaacgggcgcccggcgtcgtcgggcggcagcccgacttcgagatggcggtccggaccgatgatgcgccgcagcagtccggtcatcgacgcgactccggcggcgacgtcggtgacggtactggtgccgtcgtgttgctgacggctgatggcgaggatctgatccaccagggcagcggcccggccggtcgctttccggcattcggtgagcgcgtcacggtcctccgcggccaggtcgttgccgccggtgagcaccaggtcgaggtagccgccgatcggggtgagcaggttgttgaagtcgtgcgcgatgcgggcggcgagccggcccagcgcctccatgcggtgcacctgcgccaactgttcctgcagttcgtgccgcggggtctcgtcggagagcagcagcagccgtcctcggccgcggaaggtgtcggtgcagtaggcgatcacccagcgcggtcccgcaccggtctcgatggtcatcggctcaccgtcgagatcctcggtgacgctcagcgactccggctcgccgtcggcccggtgcacggtcaggtgcagcgggctgccgagaaccgcacccggtcggtggccgagcaggcgggcggcagcgccgttctcgtactcgacggtgccctgggggtcgacctccaggatcggtatcggcgacgtgtcgatcaggcggttgcggcgctcctcgctctcggacaggcgctcggccagattcacggcgcggcgccgcgaccgagcctggccgagcacggtggccagcagcaccaggcacaacagggcggccgcggactgcagcaccagccggtaggtccgctcccccgcgacggttaccgtgcccgtgggggtgtagccgatctgccagcgccggccgtaggcggccacctcgtcggtgcgcgccgagggccggccgtcgtccaccgacacggccagcagcgtgggagtgtgggacacatcggtgatgcgcacgttgccgctgatctccgcgcggccgtacaggccgtcgaggaagcgctggacgtccaggtgcaggcccacgtaccggtcggcaccggcggcgcggatcgccaggacggtgccggccatggcgccggaggcgggtatcggggcgctcagcgccgggcgcctggcctgcgtcgcgatgccgaacgtcgccgctgcctgcggcaccgtgctcaggtcggtgccgatcgggtagccgcgggccggctgtggctgcgccgtccggacgacagctgccccaccggcatcccggtcgatggcgaggatcgccagcgcacccggataccggtgcggcaggtcgaagccgccggagacggcggccagggcggaatcgtccccctttcccgtcgagagagcggcatccgcggcagccagcacgtccgcatagcgagccaactcgttctcgacggcacgaacatccgtggccagggcggcagccgtggcgatggtctcgtcgtggcgcgcgaccgcacccgaccagagccacgctccggccatcagggccaatgcggccgtgacgccgatccacggcagcgcccgctgtccccggcgtagcgctgccagtcgacgtgccatcgccacatcacctctgtcacgggtataacccgtccggccggcgcatgaggcggtaacccacgagtagggtccgggaacttcaggccgacggtacgtccagccatgagccgccgtggaaggtgatggtggaccccgccgtgttcgcgtcgaagtagagcgggtccttggtgtccacgaccagggctagccggtgaccggccggcaggttgtacgcggtgacctgcagcggcagatccaggaccgtgggtgacccgtgccaggtgaccggcgcgtgcgagaacagtcggctgacgccgagggcgttcacgtcgtacaggtaggcgatgaccgtgccggccggccgcgacgaggtcagcgacacgtgcaggtgcggcacgccgcggacccgccagccgccggccggcgcggcgccggacagccagactccggcatcgcggcgcgacacgaacggcagtgacgtggtcggcaggatgccggtcaggccctccaggccgttggtcagcagcgccactcccccgtcggcgacggtgtccgtgccggcctggatctgccggtcccaggtcgacgacggcaccgcggtgcccagatcgccggtggggatcagcccgtgcggcgcgcccagcagcaggcgatcggtgtgcggggacacagcggccacgtcgcggtacgactcgaccgccgtcgagtcgtgcggacgcagcaccacgccgggttcggcgccgatgccggtgtcgacgccggccaggtattcgtcgagccagcgccgcacgctggtccacacgtggttcgggatgccggccagcccggacagctccaccgtggcgtggtcacccggcgccagttccagacgcttcggcgtgctcagcgcggtgtagaagtcgagcatctgcccggccgggaagatgctgtcgccgtagctgtgcgcgaggagcacggccggatggttccggttgatcgcgtcgatcgagtaccgggcggatcgaccccgcgcccagcgctcccgggcgtcggcgttccggtcggcccagtagtcgtcgaggatctggttcatctccggcgacgggtgcccgaccaggcgtgccgcggcctgcaggaaccatgccgcctgcggccggcgggtgtcgccgccggccatcgaggcggccagatcggcccagccgctgagcgaggccaccgcgtggatccgcggatcgtgggccgcggcgagcaggctgatcccaccgccgtaggagacgccgacgatgccgatccggcccgggtcggccgcggtgtgcgcgagcagccagtcgaccgcgctcgaggcgtccgcgacatcccgcggcccggccacgtcgatcgtcccgccggagagccagaacccgcgagcggtgtacgacagcaccacgtacccggcttcggcgagcccgcgggcctgcgccagatactccaggtcgttgaatccccagctggacaccagcacgaccgccgggtgggcacccggcgcggacggggcgatcacgttggacttcagcaccacaccgtcggcggcggtgatgtcgttccagcggaacccggtggtcgccgccggccgggccgtggccggggcggacatcaccaggacggacatcatgagcaacgacaggacgatcgcgagacgacgcatagaccagatcctttaccgtcgggttaccggacagtaacaggaacgctggtcgatttgtaccgcctatttcaccggcgaatctccggccgcgggccggatcggggtcagcacggttcgaccggtggctcactgtcggtgacgaggtcgagctgggtgatggcgacatcgtgccagtcgccgttcttccaaccgatgttccggtgtacgccgaccagctggaagccgagcgccgcgtgcaggcccatgctcgcctcgttgggcagggtcgtcttcgccaccgccacccggtagccgcgatcgatcaaccgcggcagcagtgaccggtacagggcgcggccggcgcccgtgcggcggcggccgacggccaggtagacgctgacctcgcacgaccagcggtaggccgggcgggcggcgaacggaccggcgtacgcgtagccgatgatctcgccgtcgtcctcggcgacgagccaggcgtgcgaccggacggcggccgcgatgcgccgggccatctcggcgtccgacggcgggtcggactcgaaggtgatggcggtgtccagtacgtacgggcggtagacggccgcgcaggcagcggcatcagcctcgccggcggagcggattgtcagcggcatgccacgagtctgctacccgtccgcccgttccccgtccacgaagaagggctcggctgccgccaggcgcggtaccggcacgccccagcggcgcgcttcggcgagccatggcttccgccggctcgaggtgccccgctgcctcctacaggattacgcccgctggtcgcctctttctcgcttgtcgaggacttctgctcgctgctcgatctccgcttgccggtcgttgagggttctttcccgccgcgtcagcgcctcatcgcggcgggaaacggctttggcacgccggtccagggcgccgtcacgccggtcgagtgcgtcgtcacgccggtcgagggcgtcgtcccgtcgatcgaggatccggccgcggtgcttctgggcgtcggtggtggggctggtggcctcttgctggcggcgcaggtcggcttggcgctcatcgctgagtgtgcgcagcctttccaacgatgccgccatttcgccggcgaggcgagcgtcttgggacatgcttcaactgtgcacctcgccggttgcgccgggtggcgataacaccatcgcaggtaatgtgaccgcgatgcgcatccttgtcaccgggggaaccgggaatgtgggcaggctggtcgtcgaacaccttctccaggccggagcagaggtccgggtgctcagccgtggcggtcacgcgcccggtgcggccgcaacggtccggggggatctggcgcagccggacagcctgcgagcggcattgcaggacatcgatcgcctctatctgttcccgtacgccgggaccgcacccgccgtggtccggctcgccgaacaggccggcgtcgagcgggtggtcaccctgtcgtccggggcggtgaccaccggctacgacacgaatttccacctgcccgtcgagcaggcggtggaagcctccggcatgcggtggacccacgtccgcccggccgaattcatgctcaacaacctgtggctgtgggggccgtccatccgggcggagagaaccgtccgcgagcccttcccggatcgtgccgggtgcccggtccacgaacgggacatcgccgaggtggccgcggcggcactggtggaggacggtcatcacggccgggcgtacacactctatggtccggaaacgctgacccgccgggaccaggtggcggccatcggtcaggcgctcggcgaacctgtccggctgcaagccgtgacgccggcccatgcccgcgacatgtatctggcccagggcggtttcgcggccgcgtccgccgattttctcaccggcttccagagctattccggaggagagccggaggccgccccggtaccggtcgaaccgcaccccatgccgaccgcggcggacgtcaccggccgtcccgcccggaccttcgccacctgggctgtcgaccacgccgccgatttccggtgaccggttgccgccgggcgggcatcgagggcaggctgcggtcatgactgacctgatcggtggcgccgggcaggtgctcgacccggccgccgtccgcgcctccgtgctggcccggctggcggccgaggatctcggcggcaaacgggtgtgcctggtggtgccggacgcgacccgcagctgcccgctgccgctgctgctggacgcggtgcacgaggcgctgcacgggcgggccgccgcggtgaccgtgctgatcgccctgggcacgcacgcgccgatgaccgacgagcagctgcgccagcacctcggcgggccctacccgggcttcgaggtgcgcaatcacgagtggtggcggccggcggcgctggtgtcgctgggcctgatcggcgaggaacgggtggcgcagctgtccgagggccggatgcggcgcgccgtcgaggtcaccctgaaccgggcggtggccgagcacgacgtgtgcctggtgatcgggccggtcttcccgcacgaggtggtcggcttctccggcggcaacaagtacttcttcccgggcgtcgccgggcaggagatcatcgacttctcgcactggctcggcgcgctgatcaccagcgccgagatcatcggtacgcgcgggatcaccccggtgcgggcgctgatcgacgaggcggccgcgatgatcccgtcccgccggctggcgctgtgcctggtcgtgcagtcgggcaccggcgccctgcacgcggcggcgttcggcaccccggagcaggcgtgggcggcgtgcgcggacgtctccgcgcggacccacgtgcagtatcgggatgcgccggtgcgccgggtggtgtcggtcatcccgggcaagtacgacgacatgtggaccggggcgaagggcttctacaaggtggagccgatcgtcgcggacggcggcgaggtgatcatctacgcgccgcacatcacccggatctccgcgatgcatccggagatcgaggagatcggctaccactgccgggactacttcgtgagacagtgggaccggttctccgcgcagcactggggcgtgctggcccactcgacgcatctgcacggcgccgggacgtgggatccggtggacggggagcggccgcgggtgcgcgtcaccctggccaccggcatccccgagcaggtggtgcgcggggcgaacctcggctatcgggacccggcgacgatcgacctggaagccttggccgcggatccggacaccctggtcgtcccccaggccggcgaggtcctgttccgcctgaacgccgcggggaccgcacgatgagccggcggggtgccgacgaggtggtgaccgagctcgccaagatgctgaccggcgtcggccggctcgcggtcgcgttctccggcggcgtcgactccgccctgctgctcgccctcgccgcccgggcgctcggccccggccgggtgctcgccgtgctcggcgtctcggcgagcctgcccgcggccgaacgcgccgccgcgcacgaggtggcccggcacatcggcgcgccggtcgtcgaggtgctcacccgcgagggcgagcggcccgcctaccgcgcgaacgggccggaccgctgctaccactgcaaggacgagctgttcacccggatcgacgacgaggtcctcgccgcgcaccgggtggacgccgtggcgtacggcgagaacgccgacgacgcccggcgcccggaccggcccgggtcccgggccgcgaccgagcatcgggtgctgcgaccgctcgccgacctcgggctgagcaaggcggacgtacgccgtctcgcccgcgagtgcgggctgccggtcgccgccaagccggccgcgccctgcctcgcctcgcgcatcccgcacttcgtcgaggtcaccccgcaccggctcgcgcaggtggaacgggccgaggcggcgctgcgtgacctcgggttcgccgacctgcgggtgcgtcaccacgatgacgtggcccggatcgaactgctcccggaggacctgccacgcgcggtcagctccccgatccgggaggcggtgcacgcggcggtcctggcggccgggttccggttcgccgccttcgacgcggccggcatccagtccggcgccttcaccctgcccctggtcgggcgctgagcgatcgagctggacagatccctctactgtgatggcgtcgcatcgggcctcggggagggcagccgtggagttcagtcaggtgttctggtacgtcttcatggtcctgctgttcttcggcggcagcatcggcggggtcgtccagcaccttcagtcccgccggcaccggttcaagctggagatggccagggagcacaccaacctggtgcaggcgcaggcgaagctggcggaggaacagaaccgcaagaccgcgctggaggtgcggcaggcggagctggagatcgaacgctacgaccggcgcgtccccggcagcccgccgatcccgtcgctgggtgtcaccggcgaggagcggtagccgtcaggtgtaccggcgggctccagccgccggacccggtggcgcggaccgcagggcgacccggtcacccaccgccactagggtgacgatctgtccaccgggtaggcatcgaaggcggcgtgcagccggaccgctgtcgcgtcggtgatcgcggtccggtgcggcaatgcatgccggtccgccatgacgtagagcgcccgcaggaccgcgagggtgttggcgaccggaatcggcagcggcccggggccaccgccgtcgaacagctcgtccacccggatcagccagcggaccgccccctcctcggtcaactccggccgccccagtatccgcaccagtgcccgcgccgtcctgtcctcttccatctgggcataccggtacgcggtcggggtcaccgtccgccggccgatgagatcgagcagtgcggccagcgccgccgcatcgagccgcggtgaggtgcccaaggctccggcgaggtcggccccgtgcgcgatcgcgtgcagccagccgagccgctcgtcccagccgcgaaggtcatcctcggtcagccaccagtcgccgaacgccgcccgccagcgatgcactgccgcgcggtccaggactcccgtttcccggtcccgatcgacgatggcagccaggacgagcggcgcgaaggcgcgggcctggatctccgggtgaacgaggcggccggccagcatgtcgccgagtgcggtgagacgggtgtccagcgctccgccacggatccagcggaccagcgtcgagtacgcctggtcgtctcgcacccgcgggtcgggagcggcgagcatgtcgagcaggccggcaagtgcctcgtcgagatcggccggaatcggggtgtcgctcatcgcagcaggctatccacggcgatcgccgccaacggacgcactcatcgggggaggcgctgcctaaggcgtacaaatgccgatcaccgccgcagggacgacgtagccgatcaggaaaaccgtcggggagatcatcaccgcggccatcgccgaacgccaggcgggatgggcgagcgccagggtgtgcgcccggtggctgacgaaggcgtcgaaggagagcagcggggcgagtctgccggccacggcgggggtcagcaggacgaacgcggcggccgagccggcgaggacgggccgcgcgggaccggggcgggtgcggcggacgtcgtcgatcacgccatcgagcttatccctacattatgtaggtggtgattcccgatagtctcggggtgtgacgaaggacaggcggcgccccggtgcgctggaagcggccgtcatggcgtcgctgtgggcggccgacgcgccgatgacgccggcccaggtgcagcagcgggtcggcgacgatctggcgtacaacaccgtgcagaccatcctgatccggctgcacgagaaggatcaggtgcagcggcgccgcgccggccgcgggcacgtgtactggccggtgcgcgacgcggcggccgcggcggtggcccagatgcgcgccgcgctgccggacggcaccgaccggcacgccgtgctccggcagttcgccgcctccctcgacgcggccgacgcggcgatcctgcgtgacctgttcaccgacgccgagcgcccggcatgaccgtcgccatctacctgccgctgctgctggccctgccactggcgtcgatcgcgccgcgggtcgccggccggggcacgcccggcccggccgcgcgcctcctcgccgccaccgccgcggtcgccgccgtctcgtccacctggtcgctgaccatgctggcgctcaccatgctcgacgacgtaccgccgctgtccgtccgggacgactcccccggcctggagcttcccgagccggtgcccgggccggtcgctctgctcgccggggtcctcctgctgggcgccggggtccggctgctcgtcgacgtccgccggcgctggacgacgcatcgccggttgcgggccgtcggcgaggtccaggacggcctggtcatcgccgactgggcgaaaccgatggcggtcgccgtgcccggcgccgccggccggcccgggcatctgctggtcaccaccgggatcctgcggctgctcgacgccgacgagcggcgggtgttgttcgcccacgagcaggcccacctcgagcatcgtcaccaccggctcgtcgccgtggccgccgcggccgccgcgctgaacccgctgctcatcccggtccgggacgcggtcgcctacctggtcgaacgctgggccgacgaggaggccgccgcgcacgtcggcgaccgccggctgaccgccaaggcggtggcccgggccgccctcgccggctccggcccggagccggggacggcgctgggcatcgacggcggggcggtggtccgccgctagctagctaggccctcggccaggcgacccccgccacgctgcgccgccgcctgatcgccccggccctgctcgccgccggtttcctcgcggtggccgcggtcgccaccgaggcgttcgttgatctggcccaggcctgggtctgaacacccggaacaggatctagacccagggcaggccggtacgcgcggcggccgcgcccaggtacggcagaccgtacatcttctccaggctgtgcagcaggtcgtagtggtcgagccggacggtgtactggcccgccggcacccccaccccgatgacgatggccggaatgtggtcggcgtcggtccggtcgtcctcgtcgaaggtgagcacgaaccagctgttgtgcgtccgggcccaggtcacgtacttggcgaggtgttcgcgcagccacgcgtcgccggtcgcccgggagcagtcgtgcatgtcgtcgcacacgtcggggatcacgaacgagacggtcggcagcttccggtagtgcgacgggaaggcggagtacggccggctgaccgacgacggcacgttgctgaagttcgcccacggggtgtgccgccggaagtagcgggccgacccgcagccgcgccagcccgtgcggggcaggccctcggcgtatccggcgaagctgtcgccggcgtcgatcagctgacgcgccaggttgggccgggctcccaggtcgtacgggcacttgtcatcggtgacgccctgggtcgacccggagaacagcgccagatagttcggctggctgggatgtgtctcggcgtagaagtcacgcaggttcgccgcgtgcccggccagggcggtgatccacggggtctgggcgggtccgacgatggcgtcgtaccgcttgttctccaggacgacgatgaccacatggtccggcttcggcgtcgcggccacggccggaaccgggttgatcagcgccgccgtcacggccgccagtgtcgcctgcccgagctttcgcgtgatgtccactcctacatgctgtaggttacagggtgatcgtcccctcgacactccgggagtccggtggagatcacccccgtggcggccggctcctcagaccaggttgttcgccaccagctcgacggtcagggcggcggcgaccgcctcggccgccaacagcccgaccaggaccagcagctgggtggcgccggcctggaccgccgagcccccgccgagcagcaccccgacgaacgcgcccggcaacgtcaccagcccgaccgtccgggtctggtccagggccggcaccagcgcctggccggcggtgggccggcacacctccagggcggcgtcgcgcggcaggaaacccagggccagggccgcctcgtactcgccgcgccggtcgcgcagttcgtcccgggcgcgccggccggacagcgacgtggcggtcatcgccccaccgatcaggatcccggcgatcggcaggaccgcgatctcggtcggcggcaccgtgcccgcggcgacgaccacgatcccggcgagcccggcgccggccacgatcgggacgatcgccggccatccgcgccgcagggtgctgatccgccgcgccgaggtggccgccgcgaccagcaccatcagcagcaggaacaccgcggtggaccaccacgcccgcagcaccgcggtgatcagcacggacaccagcgccagctgggcgaccgcgcgcagtgaggcggtcaccaccgcccgggacaccccgagccggccgaccgcggccgccgtcgtggcgatgagcagcagcgcggtgagcaccacggccagggcggggcgggcggagatcgttgcctggttcatcccggcactgtcgcagatcccgcttccctaccagatcgcaagcccggaatgggggacatctgccgagaaagtcgccggtcatcttcaggagggtttcagcgcccgcatcgcatggtgtcggctgacaccttcccacaggagacacgatgagctactcctccagcggtctggccacgcgcaccgacagggcgtggctgaccaaggtcccggcgatcaccgccaccttctgggtgatcaagatcctgtcgaccacggtcggtgagacgttctccgactacctggccgtcaacgtcggactcggcccgctggtcaccgacgcgatcatgatgaccgtgctggcgatcgcactggtccggcaattccgtaccgccaagtacacgccctggatctactgggcctgcgtggtgctggtcagcatcgtcggcacccagatcaccgacttcttcaccgacaccctcggcgtcagcctgtacgtgagcacggcggtgttcgcggtgatcctggcgatcgtcttcatcacctggcaccggcaggaacacaccctggcgatcacctcgatcgacaccccgcgccgggaggcgttctactggggcgcgatcctgaccacgttcgcgctcggcaccgccgccggcgacctgtccaccgaggcgctcagcctcggcttccgcaacggcgtgctgatcttcggcgcgctgatcctgatcacctgggcggcctcccggttcggcgcgagcctggtggcgacgttctggatcgcgtatgtgctcacccgcccgctgggcgcgtcgctcggcgacctgctcacccagtcgaaggacttcggtggcctggatctcggcgccagcgccaccagcctgctgttcttcggcgtcatcctgatcctggtgatccgcgagcagttgctggccaaccggcacggggtcgccgagaagggcgacgggccgctcggtggccgccgcgccgactacgcctgggccggcgccgcagccgtggcgatcgcggtcgccggcgtcgggctgagcagcctgcacaccggcagcaccgacacgacggcgaccaccaccacgacggacgtcggcggcaccgccaccggcggcggccggccggcgcaggtgaaggtgatccacccgacgaccaagctcggcaacctcaccaggttcgcgacgatcaccgccgcggtcaaggccaaagtcgacaagaacgacctggccggcggcaaggccaaggtcaaggacctggaagtggcgtgggacgaggccgaggccggtctcaagccccgcgaccccggcaagtggagccggctcgacggcgagatcgacgacgtcctcaccgccctgcgcgccggcaaccccagccaggccgactgcaccgccgccctgaagaccctgatcaccaccctgaaccagttcgacggcgtctgacccgcccggcgccgggttcggccagacggccggcgctgccggccgtcgggtacgctgctggcgtagccgccatctcgaccgtgacgccggcgttccggcactgcacgggacgctgaagcgagccggcgtgtacccggtctgggggtgcctctgacgtgatcgaatcgttcgaggcgtcctggcagacggtgggcgacaccggcctccgggcgagcgccgagccggccttcgaccggatcgccggtctggcccgggttctgctcagcgtccccgtggcggtcgtggccctgttcgacgcccaggggcagttcttccccggcgccgcggggctggccgaaccctgggccactctgcggcaggcaccgctgagccacaccctgtacgagccggcagacctgcggcaaggacccgtcgtcgtcgccgacgcccgcaccgacccacgatgcgcccaccgcccggcgatcagctcgttacgggccggcagttacgtggcaatgccgctgaccgacaacgccggcaccgttctgggagcgttgtgcgtcatcggcgaccggcctcgcgcctggtccgcaacggacctgtcgcagctgtccgacctcgccctgacctgctcggacagcctgcaatcgcgaatcgctctcgggcgggccgaaagccgcagcgccgccgcgacggcgaccagccgccaggcccgggcggtctccgcacgcggcgaactcctgctcaaggccagcgtcctgctggcgcaggcgcgtaccgtcgccgacaccgtggacgcggtcgcccagctcacctcaccggtgttcgaccccgacctgatcggcatggtcctgctcgacgacgagcaccgcctgcgggtcttcggcgccgacgggctccccggcgacgtcgcctcccgctgggtcagcttccccacctcggcgccgctgccggccgccacggcgtttcgcaccggacagctgctgtccctgcccgacccggccgccatcaccgccgagttcccgcagctcgccgacgaattcttcggactgggctggaaagccatcgcctgtcagcccctccccggcgtgcacggcaccctcggcgtcctcaccctgtcctggacgcacccgcaacacctcgacgccgagcagcgcagcatcatcgtcaccgtggccggatacctcgggcaggccctgcaacgcatcgcccacctggacgcgcagtacaccgccgcccgaaccctgcagagggccctgctcacgcgactgccgcacaccgcgacgctgcggctggccgcccgctacctacccgcccaccacggtgatctggtcggcggagactggtacgacacggtcccgctcgccgacgaccggctcgccctggtcatcggcgacgtatccgggcacaacctgaccgccgccgcggccatgagcgaactgcgcagcatggcccgggccctgctcatcgaccggcccgacactccctcgggggtcctgcaccgcctcgatcacgccaatcaggccctcggcgccgacatcatcgccaccgcggtcatcgcctacctcgatccgcaaccggacggcagccaccgcctgcaatggtcgaacgccggacaccccgcgcccaccctgatcaccgccggcaaccgggtcaccgggctgcccggcgccgacccgctgctcggcgcccgccaccgtcgcccccggagcacccaccatcacgtgctcccgcccggcgccaccctcctgctgcacaccgacgggctgatcgagacgcgtgacgccagcctcgacgagggcatctcccagctgcatcgactactttcccaccatcgcgaccccgtgacgttcgccgatgtactcgccgcccacgccaacgcgcgcatccgtgaggacgacgtcgccttcctcctggccaccgccgtgccggtagccgcccgacacacgctcacggcacccgccgaaggcgactgcgccgacggcagctgagagccggacagccatcacggtggtccgggtcccggacttcgccaggaaatcgttgtcacgcgcatcaggccggtcgcggtcgacggtggatcaggacctctcgcacagcgtcgcgcaactcggccggctggaacggtttgtgcacgacccggtcgccctctcgaagcgttgcggcggcctgctccggagtgaccgagccactggccatcacgaccgggatgtcctcggtatccggggtggtgagtagttccgcgcgtgcctgcaggccggtcatccccggcatctcgttgtcggtcacgaccgcgtccggatgctgggcgcgaacctcggtgacaagctcctgaccgttgctgcacaggtccaccgtgtggccggcacgggtcagcaccctctccaccacccggcggatgccggcgtcgtcgtcggccgcgacaatatgactcaccggggacctaccttctgccgtgttccagtaccggaagggctcccaggagccccaccgaggggtatgtcaggtttcgccacaggcttttcgccggcgccttcggcgcgcgggcgtcgatcacctctggctggagctcgtcgtccgtaccgctgccagcttgtggagcaggtcagcggcggtgaagggcttctcgagaaaggcgatgtcctcgtcgaggatgtgggtggtgccgagcaggccgttgctgtaccccgacatgtagaggacggggaggtccggctgacgctcgtgcagcgactcggccagacggcgcccggagataccgggcatgatcacatcagtcagcaaggcgtcgcagccgtgttgttcgtacaggtccagtgcttcgccggcatcggcggcaacgagcacgcggtattcggcttcactgaggatgcgggcgaccatccgggcgagagccggctcgtcctcgacgacgagaacggtgctgccgccgccgagtggtggcgccgtactgtgcaccggcgcggcagcagcggcggcggactctgccgtcaccaacgggaggtagatccggaaggtcgtaccgaggttcagctccgagtagacgttgatgctgcctccggcttcggtcacgatgccgtagacggtggccagccccaatccggtgccgcggccctgcggcttggtggtgtagaacggctcgaagatgcgcttggccgtttcgggcgacatgccctcgcccgtgtcgctgaccaacaggcgggcgtacgtgccggcgggcaggggcggttgcatgtcgacctcctcgccgtccagcgtcacggcgtcggcctccagaaccagggtgccgccctcgggcatcgcgtcccgggcattgatcgccaggttcaacagcacctgctgcagctgacccggatcggtgtgcaccatcaggggccgcgtcgagggcaccgcgaccaggtcgatgtgctcgccgatggtgcgctccaacatcatctggacttcggtgaccgccatgttgaggtccacgtcctccggctggacggcctgcgcgcgggtgaaggtcagcaactgccgggtcagattggtcgcccgctccaccgccctgcgtacctgcgtgaggtccgcttgcacacccggccggtcgctcgtatccgccgccacgaactcggtgtagttggcgatgatcgccagaatgttgttgaagtcatgagcgacaccaccggccagcttgccgaggctctccatgcgctgcgcctggttgctgcgctcctccatcgcacgccggtgttcggcggcctccttggccgcggtgatgtcgcgggcgatggcggaggcgccgatgaccgtgcccgcctgatcgtggatcggggtgatcgtcagcgcgacgtcgacggcggtcccgtccctgcgcagccgtcgggtctcgtacgccatgccgcgctcgccctgcctgatccggtcgaggacgtccacctgctcgccgccgccggtcgcgtcggccagcaccgcgacgggctggccgagggcttcctccgccgggtatccgaacaggcgttccgcgccgccgttccacgccgtgatgatcccttccggggtgagcccgacgaccgcgtcgtcggtgtgctcgaccacggtcgccagggcggcccgctgcgcctcggcgacatcgcgggcggcgcgttcccgcgcgtcagcctcgtccagtcggcgctgaccccacggatccacgtacaggccacccttaccgagcagaacgccatagttgcggcgcagcgtccagtagtagacgcccacgccggcggtgagcaggtcccacacggccgaggtccaggaccacccggcggcgtccatctgcatgcggtgagcggccgggacctgcatgacagtgcgatacgccatcgcggcatgcaggccatggcccaccgcgcaactgaagaagatcaacgcggtggcggtcgccagccggttggtgcgcagttgcccagcgtgagcaaccggacccacgatcgccaccatgatcgccgcataggccaccatgatcaccagattgcccatcagaaagaactggtcctgcatgcccctcagttcgggcaaccgactcgcaacctgagcgggccggccgtgtgagcaggctcatcggctgtccgggccggtccggcgggggtcaccgacgtgcggcggcacgtgagccgggctgcggccgctcggagccggacggctgctcaccgaacaggtgctcaccgcactcggtggcggtcagcggcttggcgaaatggtaaccctgcgcgaattcgcagccgctgttcagcaggacctcccgctgacgggcgtcctcgactccctcggcgaccgtcgcgaggcccatcgtgtgggccagatgaacgatgccttcggccagggccgcgctggcgggagcggtggcgatgtcatcgacgaacgacttatcgatcttgagaatgtcgatggggaaccggcgcaggtaggccagggaggagtagccggtgccgaagtcgtccacggccaggcgtacgccgagctccttgaacctgcgcaactgcgccagcgtcgcgggtgcgtccgccaccagtacggactcggtcagttccaggacgagccgattgctttccaggccggtttcgcgcaacacctggacgacgtcgtcggccagcgacgactgttcgagctgccgtccggacaggttcaccgcgacgtacaacggcgcgtgcgggcggcgccggttccactgcgcggtctgccggcacgcctggcgcagcacccacctgccgatggcagtgatcgcaccgttctgttcggcaagcgagatgaagtcgagcggagacaccatgccgcgctgcggatgacgccagcgcaccagcgcctcacatccggcgatccgcgcatcgcgcaggtcgacgatcggctggaagtgcacctccaactcgccgcgttccaccgcgtaccgcaggtccgcctcgatcctggtgcggacgcgcagggccgcctgcatcgccggctggaagatctcgtaggtgcccatgctgcgctgcttggcggcgatcagcgccaggtcggccccctgcaacagggtctcggcggaatcggcaccggggccgctgaacgcgatcccgacatgacatcccacggtgacctcaccgtcgctgccgtcggtgaacggcctggccatggccgccatcacccgacgagcgaacgcgctcgcctgcgcgacgtgctccgcaccgtgcaggagcaccgcgaactcgtcgccaccacagcgcgcgacggtgtcggtcccccgcacgagatcacgcagacgcgcggcggcaccgatgaggatcgcgtcccccatggcgtggcccacggcgtcgttcacggctcggaaccggtgcaggtcgatcagcagcaccgcgatgcggccaccgccgcgatgggcatgggcaaggctgtgcgccagccggttgagcaacagcgcccggctcgccaatccggtcaacggatcgcggaaggcatgctggagcccgtccacggcgcgcgccgactggatcgccaccccgatgtgcccggcgaaggcggtcaggatgttctggtcagcggggccgtagctccgttccggtttccgggaggccacgaacaggcttcccaacactcttgcgtcatggatgacgggcgctgccatcgcggtgtgcaccccggcctccacgccttcgcgcagcgcgtgtgcggagtcggcgtaccggtcgaacaccaccagttcaccgcggaggaccgcctgccccgtgacgccgccggctgccaccggggtggaccagagacggtgcagcacgtcgtccgggaatccgtacgcggcgaccaggtgaagccgttccgggtcgtcgccgtcacgcagggccagcgcgacgatgtcgtcacccagcagggcctgcgtctgcgcggtcaccgtacggaagatttcgtccaagggtgcctggcgggcaatggcccgctgcaccaccgacagccgctccagcagccgggccgcctgcccctcggcatcggccgcacccgccggtggggaatcgttgtcgtggcggcgccggccggacaggcacacgcccaacgcggcggcgaccgcctcggccaccgcgatctcgtcggagcccagaccccggccggtcagcaccagcgtcatctcgccggtccacgctgtggcatccggcgcgacccttgccaccggtaccaccacgccgtcgtcggcggtgccgccgccggatgcgacccgcagaacccggtcgggctcgtccgagccgaccatcgccacgacgcggccccgctcgacgaccgccaccgcgtccgccggcacagcctgggccacaccctccacgacgacccgcatcagatccgagaagttcccggtccgcgccatggtcaggatggttcgggccagccaacgcgccacgccggcgcccgtccgctcctcgagcggctcgaggggcgcgggatccggccgcggaaggttcacaccacccatgtctcccgggtcggcacagccgcgccgaagctgagcggtcccgggaaacattcagtctccggtcccggggtgccggtttccgctcaaccgctgggtcggcgggtcgatgggcagggcatcatggtgacgggtgagcaggcaacctccggtccgcgtccggctgtaccggcctggtcggtgtacgcattcgcgcaggcgaccgggtcggggatcttcttcggcctgccagacggtctgccgcgcgcgacgttactggtggtgctcaacgcggtgacggtgctggcggtggcgacgaccgcccgccgctgcgccgaaggccgccggggttggtcactgctggccacggctcagctgctcagcaccctgggatgggtgtgctggtacctgtacccgatggccgcggcggtgaccgtgccctcaccgtcgctgggtgacgtgttcttcatcggctcctacgccctgtccgcggtgggcgtcgggatgctggcgcgccggcatgccgaccgtcgcacggtgctggacgcggcgatcgtcaccacctcactgggggtgttgctgtgggtggtgttcatcgccggccacgcggtgactccggggctgagcctgccccaacgcctgaccgccgtcgcgtatccggtgctcgatctgctgctgctggcggccgccctgccgctggcgttgaacgtccgacggtcgccgcgcaccctgctgctgctcggttgggtggcgttgcagctgtgcggcgacatggtgttcaacgtgcaggtgctgcacggcacgttccgcttcggcggggcgacgttcggctggtggctgctgtcgtacgcggtgctcagcgccgcggcgcggtatcagtcgtcgcccgcgaccggggcggcgtcgaggtgggtgcgccccgtgctgctcaccatcgcggtgttgccgctgccggtactgctgctgatgcgggcgttgcaggcctccgggcaggacgtggtggtcatcgccggcgggtcgttggcggtgacgatgctcgtggtgctgcggctgctgaccaccggccggcagagcccgccctcggccgcggtgcgggcacacctgcgccgggcggtgacccggctgtgcgcgggattcgtggtgttggcgctgctgccgctcgccggcctggcatatctgtcggtacgcgaggccaccgacaccgtccggaccgaggtggaccggcggctgaccaccagcgccgatgccagcgtcgcctatgtcgagcagaagcttgccgggctacgggccctggtggcctcctacgccgaacggcgactgctcgcggccgcactcgccgacaacgccaccgccgaccccgccgcgctgcagcatcacctcaccgggctggagtcccgcgacccggcgttcgtcggggcctgggtgctcgacgccgccggcaggatgctggctttcgatccccccacgccgagcgtcatcggcctcaacttcgcccaccgcgactacttccagggcgcgctgcggacccgtgcgccctacgtctccgaggcgttcgcgaccgcgacacccggcaatccgcgagtcgtcgcggtcagcgcgccgatcctgcacgacggtcagcttgtcggcgtgatcaccctgggataccggctggcggcgctggccgcattcaccgaccagctcgccggcgcgcaacaggtgcggttgaaactcgccgaccgccgcggcaccctgctcgccggacccggcagcgagcagcccacgctcacgtcggccaccggcgacccgcagatccgcgccgcactcgccggcggcagcggcaccgcccggcacatgtcggacggggtggagaccctgtcggcctaccgcaccgtcgccagcgtcggctgggcggtgaaagcggagatccccgcggcgcaggcgttcgccggcgccacccggttcaccggccgggtcggggccgtgacgacgctgctcgcgcaggtgctgctgctcggcctcgtgctggcggtgcgcagcgaacgtgcccgccacgccgcccaggcccacgcgggccggcgcgaagctcaggtcaccgacatcctgcaggccgccggcgacgcgttcgtctccatcgacaccgcgggcaacgtgacgcgctggaacacccaggccgagatcattttcggctggcccgcggatcaggcagtcggtcgccccctcaccgagctgatcatgccggatgaccagcgacacgctcatctggccggcgtgcagcgcgtcgccgagggtgggcaaccgcacctgctcgggcaacgcgtcgaggtgcaggcccgccgccgcgacggcgaactgttcccggcggagttgcacgtctgggcatccggcgacgccgacgacacgacgttcagcgcgttcatccgcgacatcaccgaccgtaaactcgccgaggccgaggtcgccgccgcccgggacgaggcgcttgccgcctcccggatgaaatcggaattcgtggcgaacatgagccacgagatccgcaccccgatgaacggcgtcatcggcctcaccagcctgctgctggacaccgacctcgacgcccgccagcgcgactacctcaccacggtgcagaactccgccgacgcgctgctcaacgtcatcaacgacatcctcgacttctccaagatcgaggccggcaagctcgacatcgacccggtcgacttcgacccgcgcgccgtggtcgaggacgtggtcagtctgctcgccgcgaccgctcaggccaagggtctggagatcgccgcggtgatcaccccggccatcccgcccgcgctgaacggcgatgctcaccggatccggcagattctgacgaacctggtctccaacgcggtgaagttcaccgcgcacggcgaggtcgtcgtcaccgtcgagatcggcgaacccagggacggcgtccgcgaggtcaccttcgccgtcaccgacaccggtatcggcatccccgccgaccggcaggcgcacctcttcgaagcgttcacccaggccgatgcctccaccacccgccgatacggcggcaccgggctcggactgaccatcagccgtcagctcgtcgggctgatgggcggcagcatcggcctggacagcgaacccggccgcggcagccgcttccacttcaccctgcccctgcccggtgcgggcgcgccgctcccgggctcgcaccccgacccggaactcacggatgtccgcgtgctggtcgtcgacgacaactcgaccaaccgcaccgtcgtcaccggactgctcaccggctggagcatggacgcccacgccgtggcggacgccggtgcggcactcacggcgctccgggaagccgccgacgccggcaccccgtacgccgtcgcgctgctggacatgcacatgcccggcctcgacggcatcgacctggcccgcatcatccacggcgatcccctcctgcagggcaccagcctcgcgatgctcacgtccaccaaccaggccggcgaagcacaggccgcccgcgacgccggcgtgctggcctacctcaccaaaccggtgcgggcgatccagcttcgcaccaccctgctacaactcctgggccgcacgcccgcctcccccgcaccggagcagacgagcatcgcggagcgacccggttcgaccgcgcacgtcctgatcgccgaggacaacgaggtcaaccaggaggtcacccgggagatgctcgccgctctcggctacacctgcgacatcgccgccgacggcgagcaggccgtgcggatgctgcagacgcgccactacgacgccgtcctcatggactgtcagatgcccgtgctcgacggctatcaggccaccgaagtcatccgccggctccccgcgccccgcaacgccgtacccgtcatcgccttgaccgcctccgtcctcgcctccgaccagcagcgctgccgcagcgccggcatggacgatgtgctcaccaagccattgcgcaagcacgacctgcaggcctatctgacccgcttcctgccgaatcccgcctcgcccacgactgccaccaccaccatcgccgagcaaccgcacgacatcagcgacctgctcgaccccgccgccgtcgaagaactccgcgagatgggcccgggcttcatcgaccggatcctgcccaactatctgcgcaacgcccccgccgccgccgcacagatcgccgccgcggcggcccgtcaggacatgaccgaactcgcccgcctggcacacaaattgcgcggcagcagcggcaccctcgccggccaccgcctcgccgccacctgcaccgacctggagaacgccgccaccagcggcgacgtcgtcgccgccgccaccctcgccgcgctcgtccaccaacagacccacgccacctgcgacgccctgcacaccaccctgaccctccactgagcagggtgtcgtggcgggccgccgtccgcgggggatttacccgggcggcccggttggcgatgatgcagggatgtcctcagcagccgtgccgcccggtacaccccagcccgcccccgtcgcgcccgcggaactcatcggccggttgcgcccgttcgtgctggcccgagcggtggtgcccgccggtgccgccgccgtcggcgagatgctgcccggtctcgtcgccacgctcggcgtcgacatgggtggccaggtcaacttcgtcccgaccgcaaccgtcgaggccctgggcggcctgcgggcagcatggaaggccgcggtcaccaatctgacccggctgccggcgatgagcgtgggcagcctcgaagccaccgccgggcacccggacagcgtgatctacgaactgcacagcaccgatcccttcggcgcttcgcgggtctgtcacctggacggcctgctggctaccgccaaggtcgccggcagccggcatggactgctggtcgccctgccgacgtggtacaccgtgctccttcacgtgctgaccggtcccggcgtactcgcggccttgaacgtgatgggtaaggcggcgtccgccgagcatgccgccgcctccggcccgaaggcggtgagcccggacgtgttcttcgtcaacagtgcgggcaaagccgagacggtggtctacagcgacagcatggacggcctggtggtcaacacgaacggcctcatcaaggagtcgttgttcggcccgggcggcctgctgccgcagggtcgatagccccggccgaccccggcgtcgaccgggtcaggggacccgggtgaggcgcttacgctcgtacatccgggcgtcggcgcggtgcagcagggcctccgggtcggtggtcgggccggcggcgcatcccacgctcgccctggcccggatcgcccggccgtccacctgcgccggctgggcgagcagttcctgcagccggtccgcgatccggtcggccgcctcgatgccggcgccggggagcaggatcgcgaactcgtcgccgccgagacgggccggcagggcgtcgggtccggcgcagcggcggagcacgtcggccacatgcagcagcacggcgtcgccggccgcatgaccgtacgtgtcgttgatgggtttgaatccgtcgagatcgatgagcagcacggcggcctcggcggggcgcagctcgcgcatccgttcggcgagcagccgccggttggcgagcccggtgagcgcgtcgtgggtggcctggtgccgcagttgctcgcgggccgcccgttcctcggtgacatcgcgcgcgttgctgaccacgccgccgatgccgctctcgtgcagctggttgacggccaccacctcgatccaccggtacgagccgtcggcgtgccggaaccgggcgtgatagctgatctgcgcgccgggcgcgccgaacaggacgtccgtgcggctgctgagctgcacctgatcgtcgtcgtggatgagggtggtgagccggattcccatgaggtcctccggttggtagccgagtacctgggcgaccaccggcgtcacgtacgtgatcctgccctcggcgtcacagatcgaggtgatgtccgaggagtgccgcagcagcgcctcgagccggttgtgctgctgcccgagctgcttgacggtgtcgtcgaggcggtccagcaaccgggcgttctcgctgaacgcgactgtctgccgcgccacgaccagcacgaagttcaccaggagcccggccaccgcgccccacgtctgtgcggtcgtcccgttcagcagcgagacgatcagaaccgcgaagacgaggatggtcgcggcgtacggaagaatgctgaatcgccgtcgcgggcgcgccggcgccgccgccgggcgtggcccgtgcgcctgtcggcgttcctggagtcgcgccgacagcgccgcgagaacgcacggcagcaccagcgtgaggccctgcacggtcagcatctgtccctggacgccgaacgggacgatcatgttcgcgacaccctggaccgtcgcggcggcgacgatggcggccgcggccgcaccctggaccgggctgcggcctgacaggcccagccgcagggtgacgaagacacccaccatgagcacgatgaagccggacatggcggtggtgaacgcggagaagccggccgcggtgatgcctgacccgatcagcagggcggagaacaccacggtggcggcgctcagcacggtcgccgcgtccaggtggaagcgcaaccggacggtcctcgacctggttccgatcgggtaggtcagggtcaccacgacgatgagcagagcgccgacgagtgcggccccggcctgcgtgggcacggcgtccaaggttcgcgccgggccgccgaccagagtgaccagggcctggctgaggtcgcccgccgcccacaggccgccaccgatggccatcgaccgccagaagcggcgcggtgctccgtccacgcctcgcgccacccggcgcgacagcaggaggatcgccaggtcgagtgggggcagcgacatccaggtgacgagcacccgggtacggtcgtcggcaccgccgagcaggaaccagcatgtcgcggccaggccgcacaggcccagaccgacgatgaccggatcgcgccaccagcgccgcacgcgtgccgtctccgttcccggctcccggggcaggcggccgatcgagtcgctcatcggccgtcccggcgtccagttgagcgaaatcaggtcagccccgcggcagcgagccggcgcggacgcggccacacaaatgccgacccggcaaaggtgaggagtgaccgatctcgagttcaccggaacctctgagggcgcgctggaaacgagccgctcgtcctcacggcagccactggcatcggtcaacgctgggtcggtcctttcccgcgatcacctcacgatgatctgccagaccggtcgccgcaacgcgcggccggtccggcagatacggcgctacacctccggaacacccaggacgccaacggcattcaagccgaagaaacgcgattcaggggattctttccaccacgccaccgcgcaacttcccgccaagaactgcggagccggtcgactgcccgcttgggttcgcaccttcgtacgcatgaccttcttggctgctttcatcaccgccgacccgaattcttttgattctctcgattcatcgctcgatgaccacgaaagcgaacctgaaaccaagacatcggcatcgttcaccccccgctcgactcgcgctcggtcgagagcagcgacatatcgcgtactcggcccagcaaagagaccatccgcttgccgcacgctcggcaagacaggaaacgttcgttcatcccacagcagaacccttcgagccttcgcctctgcaatggagcctacaagggggggctcgggagtaggccacttaaaaccatcgacaagcagcaggccagggatgatgccccggagcgaggaaataagaatctcctcatctccgggcatcatgatcagatacaagcgtttgatcaaagctatcccttcgggatcatccacacctgatgaccgcccgactgttgatggaaccgccacatgttatcaacctcgcgcattgtgggagtcttgccatcggccaatgtgtcgactgtattgatgtggaagagggcacccgtctcgtcatgctggaaggttaggtcggtcttcgacgagccacgcacaccaccagatggacctggcacatagtactccggcatgtcgtcgccggttactgcgtcacggccaccgttcttgtgagaccagccaggattcgccgcaagaaaatcgtctcgcacattatcaagttgttcctttactgcgggactaccccgggacccataaggattcggcgggaaaacttcttttccacctgtcgcgcattggcagctggatgaatgcttccgaccgttggttgctcccgacccaccgcagttgtgtactaggactggctctatgccggcgagcacataatacgtgtggatgtcgttgaccgtgaggtcgtccatccatttgaggccggtccaaaccttgatcgcggcaacggtctgggtggtctcgctgtcagcgttgcggagcttgtcgcccgccttcaggtctttggcttcgacccagtcgttcttagacgcgtcccagaacggatggttggccgtcgtcttgacccttgaaatttttccggtcttgccgtccttgaccgtaacctcggccagatctttgtcctggtgatgatggaggacgctgaccggtttcgcctcggtgtcgccggtcttcgggtcggtggacaagacctggtcgccgagctgaaccttggcgatttccttgtgggagccgtcggccatgacgacctgggtggacgggtcgaaactgtgacaccgtgaggtgccgccggtgaccgcgccgatcacggcgccggtcgcggtcgcctgggcggtttgggaccagttgacgtggccggtggtggcgaattgttcggcggcgtcggagataccgccgccgatgccgccgccgagcgcgccggaggccatcttgccgagcaggccggcgccgagcttgcacgcggccagaccggcgagcttgccgccgatcgcgccgcccaggccgccggtggccgcaccgaggacgccggtgaaggcggcgctggccagggatgagcccaggtcggagaggctgtggatgtccccggaggccgcatccttgatgatgctgatcgcgatgccggcgacgatgccgccgaccgggccgagggcgacggatgccgcgatggtggcggccatcgcgacggccgcgatgatctgcttcttgtgctccttgacgtacttgaccgttttgtgggcgacgtccttgacgaccttgacagccttcttcgccgcccggaccacccgttccttgagggcgtggcccttgcgctgcgcatcgcgatagctcttggccgcctgacggcgctgatcgcgggccttctgcgaggcgtgtttgcgaccctgctcggcgcgcttggccagcttgttcaagccgacccgtttggcgaccttggcgaccttgtccagcgtgtacgccttggcgctgtagtagtacgaggacgcggagtggtaggtgtacgaaacgtagctggcgcccatcgaataggtttgcgacgcgtacgagctgaccgtgtgcaccgcgttcatcgtgtgggagccgaccgacttgagcgcgcccatgatggagaagtgaccggtcgggtcggtgaccgtcagggggttggcgctggcgtactggtagcggttggcgtcgatcgagtccggtaccgggttgttcgaggcggtgtcacggttgtcgaactgaccggtgccggtgttgaaccagcgggccgccatgttgacgcggttcgtactggcctcggtgtactcggactggtaaccgagctgacccaccatccccgaactggacttgacggcgccgagcgggtcgtaggtggtcgaaccggtcagggcggtggcggtggcggtgaactggccgaccacgtcgtcgtgcaggtcggtccagaccaggcgggcgttgctgcccgcggcggcgccgaccaggcccgcgctcggatcccgcacgtacttcgtgccggagtcgtcggcggccaggtcgttgccggtaccgctgtaggcgaagccggcctgcagtgcccggcccagggcgtcgtatccgtaggtctccgtgctgcccgcaccgtacgactgggtgatcgtctggtcgaaggcgtccgaggtggtggtggcggacgcggatgatccgaccaccgacctcagggtgccgcgagcggtgtagccgtaggagactcccgccgagtcggcgaccaggcggttgcgggcgtcgtaggtgtaggtggtggagccgttgccggtgcggttgccggacgcgtcgtatgtgtagccgatcttggtggtgccgttgttccacgaggtcaggcgatcggccaggtcgtactcgtaggtgttgctgaccgtcgtaccaccgaaattggtggtggttttcgaggtttcgttgctgttggcgtcccagccgtagccgatcttcgcgatcgacgtgccgcctgaggttttcagctcgtcgccggtgaggcggtgcaggccgtcgtaggtgaacgaccggtagttgccggtgccgccgtaggtgatctgcttgaccgccgacgtctggtcgtaggtgtaggtcaggtccgtgcccgccgtggcgttcttcagggagaacagacggtcggcgttgtcgtagacgtagttggtggtgccggcggcgtcggtgcgcgaggccatcaggccgtcgtcggtgtaggcgaacgacgagttcccggacgggcccgtgatggcggtgggcaggttccggtcgtcgtaggtgaccgtgttgtcgtcggtcggcgacgagaacgtggtgatccgcccggccaggtcgtagccgaacttgcgggtggccgtggtggcttcggcgccggtgccggcttgggcggtcagcccgcccatggcgtcgtaggtgtatgtctgctcgaccccgcccggcgaggtctgcttgaccgcattaccggcctcgtcgtacgtggtggtgtacgaccggtcggggagggcgacgtactggctggtgaccggttcgatctgggattcgggcaggttccaggagttgtacgtggtccagaacgcgttcccgcgcccgtcggtgtaccgggtgcggttaccgagcaggtcgtagccgaacgtggtgtcgatcgccgcgccggccgagatcggctggtgctcggacaggaccatgccggtcgagtcgtaggtgaacgacgtggtcgtgccccgcccgtcggtcgaggtgagtacgttgccggccgcgtcataggttcgtgagctgccggtcagcacggcggtgctggtcttggtggcgtacgcggcggtcgcggtggtgcggccgagcagatcgtaggtggaggtctggtaggcgccgtcgggctgctcgacgctggtgacccggccgagaccgtcgtacgacgaggtggtgatctgccccgcgccgtccttgacggtgcgctgatcgccggcgttgttgtaggtgtagctttcgctcaccccggccggcgtcttcatcgactccagcagccctgcggtgccataggtgtagttggtggtgtacgacttgccggtctggcgcaccgcctgcgtcgaggtcagcttccggccgagatagtcgtaggtcatcgccgtggtcgctccggtcggaccggtggcggtcagcggttcaccgtcctcgtcgtaggtgaccttggtttcgccgccgttgggcgcgaccgtcttggccaggcggccgagctggtcgtaggtgtaggcggtgatgttgccgcgctcgtcggtcgacgtcttcgtctgcccgagcgtgtcgtactcgaccttggaaaccgggttgatcgtcaccccgcccggcgtggtgtacggggcgccgtgcgtctcgtaggcgcggcctgcccggtcgtacaccgtcgtggtcttgttgccgttggcgtcgaccgactcggtctggtcgccgaaggtgtcgtaaccggcgtagttgaccggccgggcggtgaccttgccggtgaaggtttccgcgtcgaccgtcggcgcggtggtcacggccgggcgctcggcctcgtcgtaggcgacgtcggtgacattgccgagcgcgtcggtggcccggacggtgagaccgccctcgtcgagagtgctgctgctgcgcgacaccgtgccggccgggttgagaccggcggcgatctgcgcggcggtgagcacactctggtaggcctgcacgtcggagatcgacccgttgaagctggtgccactgccgggcaggccgatccggataccggtggccgcctggttcaacggcccactcgcggtgagggtggtctcagcagtgccgttgacgtacaggatcgcggtcctgttctgcgggtcgaccgtgacggccagctgcgtccacgcgcccaccgtgggtgatttggtgccgtcgccgctggtggtagcgatgctgccatcggtgttctgcgcgccgagtgtcaggtgccaccggtcggtggaggcctggtagccgagcgcgagcggggcggtgccgagtttgccgggcagggtgagcaccgagccgttggcggttttgccggccagcttcaccatcgccgacaccgtgtacggcctggtggtgtcgaccggggcatcgtcgccggtgatcgtggaggtggtgccgtcgaacgacgccaccgcaccgcgcgtggtgtcgttcacccacgcgaccttggtggcggtcagacggttgttgccggagctgtcggcgatcgcggtaccgctggtctggttcagcctccagcgggccgccggggtcaggtcggggtcgccgttgtaggcggtctgcgccgtcatccggccttcggcgtcgtacttgaaatcggtcgccttgagcacactgccggtaccgacctgctgggtggtgcggaccacgttgtcgttcgcgtcgagaacgttggtggtgacccggttgaccccgtccgggtcgaccgtgaccgtggtctgccggcccgccgggtcataggtgaacttcgtcttggtgacgaggttgttggtccactgcgtgacgaggttgttgtcggcgtcgtactcgttcttctcctgaaggtacgagttcgtcccgtcggtgacggtgaccgtcgaggtcaggccgttgtcggtgtacgtgtacgccgtcttgcggcccatcgcgtcggtgcggctggcgagccggccggccgggtcgtacttgttcgcctcggtggtgaggtccttggcgaccgacgggttgttcggatcgccggtccagcccttcatcgtctcggacagcacgttgccctcggcgtcgacgtcgaacgcggtcaccccgccgtccgagtcggtttcggtcaccacctggccgtacgcgttgtaggtgaaactcgtcgacttgccgaccgcatcggtctgcgactgcttctgcccgtgctcgttgaacgcgaccgtctgggtccgggcgacgtcgccaccggtgctgtccgcgatcgtctgcgacgtcatgttgccgtcgtcgtcgtacacgttcgtggtgaccgcggtgtgcaccgcaccggtgacccggttagtgatcttgggatcggtctcggtcagcacccgaccctgctggtcgtaggtgaacgacgaggtgcgcccgttcgggaacgtgctggtcgtgaccgtctcggtgagcttgcggccgagattgtcgtaggtgtaggtactcacctcgccggccggcgacgtcgtcttcaccacgtcacccgcggtgttgtacccgatcgtctgcacgccgcccgaggcgttgacgatccgggccggcaggcccgccgggctggtgctgccgtcggtgaactgggtggtgatcctgcgcccgagcgggtcggtcgagccgagcgggttgcccttcgcgtcgtagtcgtaggtggtgcggtacgccgtgtcctgcggtgtcgccgaacggccgtcactactgctgatcatcacgtcgttgcgcggatccaccggattcgacgcgttcaggtagtagccgaagtaggtgctgaagcagaggttgttcttctggtcctggcaggtgatctgctggatcgtgttgccccgggcgtcctgcaccgcctgcgtccgagcgccgttcgggtcgtagaccaggctctcgaaacccccggtgtcgtacccgtacttggtgacattgcccagcgcatcggtctcggatatctgccggttgttgaccaggtcgtacgcgtaggcgatggtcttgccgccgggatcggtcaccgtgacgttcttgaccggcatggtgatcgccttgaccgtggtgtccacggtcgtcaccgcgaccggcacggtctgcttgctcgcctggaactgcgcggcgacctggtcggcagtcaactcgctcgggaagaacgccgcctcggccagcttgcccgcatagtacgacgtggtgttcgccgtcaggccggaccagccggagccggtggcgccggcgcccaggtacgcgtagggctggccacccgcggtgagcgcagcggtaccggtgctcgaaccggctttgacgccgtcgacgtagagggtctgcgtggtgcccgaggaggtcagcacggcgctgtgccaggtgccgtcgttcaccgcggcggccgaggccagcgacagcgtccacttctgcgcgtcgctgccgtcgcaggtgtagagctgcacctgggtgccgctggtcgtggtgggcgagtacagacacttgcccgagttcgggttgcgcaggccgccgttgtagggctgccacacctgggccaccgaggagttgcaggtgtagagctggatcagggtgccgttggcggtgccactgctcttggcgtccaaacatttgccgagcacctgcacggacccgttggcggccagcgtcatgttctgcgacgcactgttgttgcagtcgtagaactggatcttggtgccgtcgacgttgctgccgttggccacgtccaggcacttgccggcgaacgctgagcgcagcggcccggtcggggtggtcgacggggacagggcgcgcagcttgccgtccgcgctgatccacagggtcggcagacccagggcagtcgtgtcaccgagtgcgccggcctgggaggccagcagcaccttgccggtggcggtggtgttgaaccagagaccgaccgaggacgcgccggacggcgccaccgtgccgggaagcgccacgctggaggtggtgccgtcgaaggtggcggcggtggaattgctgaacggaccgctctggccgagggtgaccgcgttgtaggtggcgttgtcaccggccacctcgttcaccgcgtcggtggtacccgcgttcgtctcgccgaggcgccagtagttggtcggcttgccgccgagcaccgacgcggcgtacacgtcaccactgccggtgatggacggcgcgcccatcgtccagacgccgccgttctcgtcggtcaccgacgtgacctgaccggtcacattgctgaccgcgacctgagcctggacccggccgccgggcgaggtgatcgactggatgatcgcgctgggtgtcgcggcgacctgatagatcgcggaaacgtcggtggcggtcagcgccttggtgaagaacgcgacctcggcgatggaaccggtgaagtaggtcgccggggcggcggtgactcccgtgttcgcgtgatccggccagccgccgccgaggtagccggcgccgacgtattcgtaggccgaaccggttgcctggtacatggcgatggtgccggtcagactcgcctgggcgacgttgtccaggtacagggtctgggtgttgccggcaccggagagcacgacgtggtgccagttgccgtcggtcaccgccgacttcgacttcatcggggtggtcaagccctggtagaactcgccgcgcagatagccgttcttgtcgacgtacaaggaaggcgtgtagttgctgatggtggtacccgcggtcagtgcggcggcgctgtagctgaacagcacgccgccgggggtggtcgtcttgaaccacatgctgaccgtctggtaggagccgtcggcaaccagcttgccgggcaactgcacggaggacgacgagccgttgaaggtcgcggtggtggcgccggacgcgcccagtgccggtgcggcacccagcgtcacgttccggtaggtgccgttgtccatggcggcgttcgtcagcacgctgctgaccgcggaagagccggaagcctcgttgagccgccagtacgagtacgggttcaggttcagcaccgcattggcgtactggttgttcgcgttgccccaggcgtagacggtgcaggccgtcgtggtgccgggcgggcagaccgtggtcagctggtcgttcgtcccgtacgtgtaggcccaggtgtaaccggacgacccggtcgccggcgcgtccgtgacgaccgtggcgacgtggttgcccgcgttccaggtgatcgtcagcttgcggccggaggcgttggtcatcgtgctgacgtgaccggcggcgtcgtagtcgaacgacagcgtacgcccgttcgcgtcgatgatcttggtgaccttgaagatgccggtacccgcggcccgtccgaagacgtactgggtggcgtccttgtcggtcagcgtgtatccggtgaccgtgctgcccgaggtctgcgcggtgaagatcgcatagcggccggacggcgcggtgaacgtgccgtcgctgttgcggccgaaggccacctcggagccgttcggataggtcacgacgaccgtctgcaccgcacccgcgatgtcggtgcgctcggtcgccttgaggtccaggatgctggcccagcccagaccgaaagctccggatcgcctggtgtccacgctgttgtagctgcgcgagatctccagcgccgggccgacaccggcgacctgcgcgtcactggccgatgtcgtgtagttgccgttgttgggatcgaaaccggcgcccgggttctgcgccagatccgaggtcagccgtggctgcggcaccggcgtggagaacacgtacccgccggtctcggccgaggtaccgaccgtgtcaccgaccttgacggtgtagtagtacgtgttgttccacgccagcttcccggccggcacctgccagccggaggacgtctgggcagccgacgtgaccaccactttgccggtgccgtcgtagaccgtgtacgtgtaggtcaggcccttgttcgggtaaccgtccgggtcgtgggcccgggtgaccagctgcggcgtcagcgtctccaccgcggtgttgtccgcggggtaccgggtgtccacctgcggcaccacgttgggggtgtaggtcaggctcagctggggctcgtaagcggcggaggcatagttcgtcgaggtgaaccgcttccacccgagcttgtcggtctccgaggccagcagtgccaggccgtagttggaggtaccggacgtccacccgttgaacgtcgccacgttcagcggcacggtcacccacttgccgacactgcggttggcggcagtgttggtgcaggccacgccgggatcggtcaccgtcagcgagccgatcgggctggcgccgatcggcgcccccggcaacgacgccgtcttcagcgtgtccacaccccagtccgcggtggccgcgtagaccgagaacgcgcggttgtagtcacacgagtactgccaggtcaggtacagcttcaggctggccgaggtgacccgctgaccggtggccggcgtggccgcaccggtgaagtggatgaacgagcgggccttgacggtgccgtcgtaggtgccgaccggcaggttgtcgccgtcctggtcggccgcggtggtgctcgagtcgttgtcgacgtagacgtcgctggtgtcaccggtcgtgaccgtcgggtccacccggaccgggtagacccgggccggatcgttgagccaggcccgatcggcgacaaccttcagcgccggtttgccgccgatggtgatcagcgacatggtcaccgcggaggagtgggccatgtcgccggtctgcggatcgaacttggagtccttcatcgaaccgtgcgggaacgaggccagcaccttgccggcggcatcgaccaggtcgaccgagccgtcggcggtcatccgcggcgtcaacccggtcagccgcagcgggaacacccactggttgccggccgccggggatgccagaaccagggtctccttgacgccgtcagcgatggcctgcagctgcaggttggtgttcggcagcaccgagggatacgtcgccacggcgccggccacggccggggcgaccgccgcggcgccgctcaggtcgtagccgaccgaggcgcccgacggcaacgtcatcgacaccatcggtgcgaccggcgcggtggtcgccgtggtcgcggaccgggtcagcgccgcgggcgagctcacctgcgaagcaccgagcgacaccttcagcgagttggccttcatcgaccaccgcgagcccgacggcaccagggtcgcgtcgatcggctgccaactgccgtcctcggcgcgatagttggtgtgcccggccgtgagctgctgggtcaccgagccgtccgcgttcgcgaactggctcatgctcgccttggacctgtccgcctgccgcttgctcgtgcccgcgtcgaagccgcgccgtgcacgagtagtgatcgcacccgacgaaccctcgtgaggctggaagccgtcaagaccaccccgggccctggtctgcttccggcctgcccgaccatgcgcggaggtcgcggaagccgacacatagccgccatgccccgcgtccccatgctgctgcatcggcagacccgtcaccgccgcccatacccgcggcaacgtgaacaggtcgaccagccagctcaacgggaagctgcccccgggctgcacgacctccgccggaacggctacggaaagtccgaagaccagagcagtgagcacggcgcaacgccgccaccaagacatcgcgatgaactcccccgtgcgtgatgctgtcggcgagggagtcttcctgggaagatcatctcaaacaacagtgagttggctgagattccgataaacgtttggcctgctccggcgagccgttcggcatttttcggcgaaatcggctagcggttcaaaacgccacccacgacctcatcgatcttcgcggctgccacgacggtgacattcgagcctgccttcaccccgccgatcaccaggaatcgctgaccggagtgctgcgccgcggccgcacgcacggcctggtccgggatcccgggctcggcgacgatcaccgaacaccggccgagaacgagcgtgcccacgaatgactcagcattggccacggactgctcaccggtcacggcgaggtagcggacctgaccgtgcgtgcgcgccgacgccgactgcatcgccgcccagatcggggccgcgtccttaccggccaccccctgctgatcggtaagcaggcaagcggtcgcgtcgcggtactcccggggacgcggctcctgcgggtcaccgggcagtagcgcccaggtgaccccggccgcggccagcgcggccgcagcaccgccgcccgcgatggcgatccggcgcggggtccacgcccacctgccggtacgttgaaatccacgcttcacggtgcgacacattagcgccggcctgccgtcccgtcagcagctccagcaggttcgtgacctgcgactatgcggcggatcagcgggtacgtcgtggcgcggtgagcctgccggcgacccaccgccgcgggcggtcggccgggtttctgacggccgacggggaccgaggggctgtgcgcatcggcgaatgtcgatagcctggcgcgatgcgcatctcattctggagtgcagcggtggccgccggcacggtcgccatgacggtgctcgccggcgccgctcccgcccacgcgatcgcgaacggggaggaggtccccgacggtcagtacgggttctccgtcaagctgaccatgacgggcatcccgaccgccgacggtgggcgccgcaacagtgggtgttcgggagccctggtctcggctcggtggatcatcacggccgggcactgtttccgggacgcgaacggggtccgggtggagcacccggtggccgacctgaccacggcggccgtgggccgtaccgacaccaccgacaccagccgcgggcacctgctgaaggtggtcgccgtccggcagtcaccgaccgccgacgtgtcgctcgccatgctggaggagccggtccgcgacgtccgcccgatccggctcgccggcaagccgccggcggtcggcacgatcgtgcggctcaccgggtacggctcgctgaccagcagcaacccggtgccggtgaaccggctgcggaccgggcagctgcaggtggcgcagctcagcgacacggtgaccgggttccgcggttacgcaccgcaggccgacaccacgccgtgcccgtacgactcgggcgggccctacttcaccgagagcaaagggatcccgaaattggtggcggtggtcagcaacgggcccagctgcccgcacaccgcgatcgagaacggcgcccgcaccgacaacatcaccgcctggatcaggaaggtaatccactccggcagatagggctcgtcggccgcggcacccccgggcggggcgccgcggccgatcggtcagcggatcaccgtgatccgggtcgccgcgctggtcgagccggtcaccgacgctgagccgaggtactgcgcggtgatccggtaggtgcccttcgcgcccagcgggcccagggcgagcaccgccctgccggcacggtcgaggcgcaccgtgcggaccagggtggacgtgccgttggtcgcgatcaccagcaccgtcccggacggtgtgacgccggccgcgccggtcaccgtcacggtgagctgcgccttgcggccggtgtggaccgtgccggacttggcggacaatgcggtcttcgaggccgccgcgaccaccttcagggtcaggttcgccgacgagccggcgtagcgggcgtcgccgtcgtagacgacccgcaacgaccgggtgccgaccgcgatggtcttcgccagccggacggtggctccacccccggccagggtgccggagccgaccgaggtcccgccgagcagcacccggacggtacccgaggggcgctccgccagcttgccggtgaccgtcacccgcaccaccggcacactgccgtaggtcaccttcgtcgcgtccagggtcgcccgggtcgtgctcggggcgagcaccacgcgtacggccggcaccacggcctggttgatcacctcgacgttcccggcgacgtcggtggcccggtagagcaccgtcaaccgggtctgcccggcgcgcaccggcacggtgtacggctgccaggtgcggccgccgtccaccgaatacgccagcccgctgacgccggagtcgttgtcggccgcccgcagtgtcacggtccggctctgcgcgtcgaccgtggcctgcgacaccgggggcgccgtgtcgatgcgcacggtcaccgatccggttccggagctgttgccagcggcgtcgatggcggtgtattcgaccaggtagctgccgtccgcaccgagggtcagcggtggtgcctggtcggtccactggccggccgggtcgccggagcgggtgacccggaccttcgggaccaccgcaccgtcgaccgcgtcggtggcggtcaccgtgaccgtcgccgggccggtgaaccatccgctggccggtacggccggggtgacggtggcgctgaccaccggcgcctgcacgtcggggacggtcaccaccacgccggccttgacgttctggctctcggcgacggtgccggcgacggtgaacgtgcccggctgggcgtacgccgccggcggcacggcgtcccaggtgaccgcgacgctggacgaggaaccgtccgcgaaccgggcggtgacccgggccgggagagccggggcgacgccggccggcgtgacgagcggaatcgggtccaccgcggtgaccagcaggttcggctggtaggcggtgagcagccggtcgtactcggcctgggtgaccggcaggacggtgccgtgccgcgggctggccggcagcgagtacgacgcgaccttcgtccacttgccggacgccaggtccgtggtggtgaacggcacgtacccctggccgccgaactcgtcgatgaacaggtaccaccgctgctcggtgttcgatttgaacaccagcggcccctcgcccgcgctgatgctgccggagccgatgcactcgctgacgaagtcgtagttcgtgctcaggatcgaggcggacttctcctcgatcaggaatttggcgcacggcgtgctcgaggtgttgttgcgctcgtccttggtgaaccggtagtactcgccgtcgttctcgatcatcgtcgagtcgatcaccgagtagcccgggtccttccagaccttcggttcgctgaaggtgtagaagtcgcgggtcgtcgcgtacatcatccggttgtaggtgttgccggcgtgcgcggtgtccgcggcgtcgtagagcttcgaagcccagaagacgacgtactcccccagggtcttgtcgtagaaggcctccggcgcccaggtgttgccggcggtgtccggcgagaccttgaccaggcgctggtcggtccagtggaccaggtcggtggactcccacaccatgatcgatctactgccggtacgctgcgacgcgtcccagtcgccgttgccgtagatcttcaggtcggtggcgatctggtagaacttgtcgccctcgggcgagcggatgatgaacgggtcgcgcagacccttcgtgcccagcgtcgaggtcagcaccggcttgccgtcgttgacctcgcggtaggacagcgggtcgttcgccctactcaccgcgaagtgcagctgctcgccggtcgcggtgccctcgccggtgaagtagctgaacaggtacccggtccgggcctgggccgcgggcagctcgggcacggtcgcggtcagcgtccgggtggccgaggccgcgccggagtggaccgtcgcggtcagagccacggtggtggcgccctgaccggcctgcggccggtgcacgacaccggtgtcgtcgatcaccccgggccggtccgacgaccaggtgaccgtggtgccgtacgccccggtggccggcagcgtcaggttgccccggacgtcaccgaggttgcgcacggtgagggcggtggcggcctcccgtaccgcgtcctcggcgctgagctgcggtggcacggtgaccgggaaggatctggtggcggtcagcgaaccgcgggtgagggtggcggtgagcgtcgcgctgccggccgcctgcccggacggcggccggatcaccacgccggccgcggtgatcaccgaggcgtcgctggtggcccaggtcagcctcgtcccccggggtgcggtcgccgggaggctcaggtccgcggtgagggcggaggtgtcgccgagggtgagcgtggcccggtcggctgccagctcggcggagaccaccggctcggcgaggctctgcagctccgggtcgccgagggcccggtcgtacacccggaagtccttgatcctgcccttgagcagccggtcgccggtgtagttcgacctgccgaggtagttcgcgctggtcgtgccggcgccgatgtcgcccggcttgatggtgacggaggtgttcgtggcgatcggcgtgccgtcctcgaacagcgtcccggtggtgccggtctgggtgtacgcgaggtgtttccacgtgccgcgggcgagcggctgcggcgcgggcgcctgggtgctctgctccttggtccagttcgccgtggagatcgcggtacgcaggttgttgccggtcgtgaacaggtatccgttgccgtacccggtggaggtgtcggtgttgccgaatccgtagaggaagtacggggtcggctggtccgcgtcgaccaggacgtcgaacgacaccgagattgcggtgagccccgacatgatgtcgttcgggaccttcacgtaggtgctggacccgtcgaaggtcaggccctggccgccggtccaggacgccgtgccggcgaccgtcccgttgtgcgcgtggccggaggagtcggtggccaccgacccggccgtctcgtcgagtttgtaccagagcacgagaccgtcggtgatcgcggcctgatcggcccgggccggcgtggggaccaccagcatggccatcagcagggccagcacgctggcgattttgaagggttgttgcatgttcgatcctccggggggcggccggagcggctggtgcggacggcgccggccccggcggtgtggaggaagtgtgagcgctaacaagccaggcgtcaagatccgtcgatgccacccggatgggacacagtggccaccgtctcatcactgtggaaggcgctggtcagcgcgccgccggtaaagaccgcgaaatgacgttcacttgcaagaaatggaaggacttgcatagcaccccgtgggctccactatggtcggccggacgtccacaggaaggtccatgccatgtcacgcatcctgcgcagagttctgctcctggccgcggcacccgtcgccgccctcggattcctcgccgcaccggccgccgccagcccctcccccgccccggtgctgcacttcaacgccgacggcagcaccgcggtcgacggggtcatcgagtccggccacccggtcaccgtcgacttcgacccggcacgcctgccccggtgccgcggcaccgacgagtacggcgactcctggggcatctccgtccagtaccgcatcgacggcggcgacctgcgggtctacccggtcacccagcgggtgacggccgacggcaaggacaccacggtccgcagcctgggcaccctgcaactgcgcccggacacccaccagctgcagatgtggttcgtcgccgaggaccgcaccggctgccacgaggaggacaccgccggcggcgcgaactaccggttcgacatcaaccagccgccggtgctggcccgcgccgcctacaacgccgactggtcggagaccgtgaccgggccgctgcgccggggcggcgccctggtgctcaactacgatccggcccggctcccgcagtgccgggccacctaccgcggctaccccgcgtgggagatcgacgtctactaccgcttcgacggaggcccggtgcagtccaccccggtgaaccaggccgccgaggcgatcccggtccgcatcgacatcccggcgaacgcccggaagatcgagacgtggttcaagaactccgacccgtacacgcagtgctcggcgtacgactcggactacggcaggaactacaccttcccgatcggctgatggcgggcacgggccgggcagcgcgcgactgcctggcccgtgccctctacggtgagcggcatgaccgaggatccatcatcatcacgacgcgagcgactcggccgggtggccacgacggtcgctctgctgtcggtgccgctgatgtcgctgctgtgctgcgttccgggcttcgccgcgctcggcgggatggactccagctgcggcaccggcttcgatcacgactgcctgaatctctcccggccggtcttcaccgtctggccctgggtgaccggcggcatcgccgcggtcgccctcgtgacccggctcgcgatcccccgccgggccgagggacttcgcctggtggcgggagccttcatcgtggtgccacccctggtgaacgcggtggcggcgttcgccgcggtgcaccggcccggcgtgatctgagtcgtcgcgcccgggcccggctcagcgtcaggagagggcgcggaccaccggcccgtcggggtggcgaggcagcggcggcagctccggccggtcgagccaggcggtgaacagatcgtccagactccgggcgctgaaccgcgccgcatgccggcggaactgttcggtcgtcaccgtccggtgctggttctccgccacccaggagcgcagcagcgcgaagaacgccgtgtcccccagccgcacccgcagcgcgtgcaccgccagcgcgccccgcttgtagaccagcgggtcgaacatccgggccacgcccgggtcggccaccgccagatcagccggctgcgccgccgcccaggcgtgccactgtgccgcgtgcgaggccgccgaaggcccgccggaagcgccggaccacaaccattcggcgtacgtcgcgaagccctcgttgagccagatgtgccgccagtcggcgacggtcaggctgttgccgaaccactggtgcgccagctcgtgcaccaccaggcgctcatgggtgcgctgcccgtccaggtggttgcggccgaacacggccatgccctgcgcctcgatcgggtcgtccaggtcgtcgtcggcgaccaccacgacgtactcccggaaggggtacggtccgaacaaccgttccagagcttccatgatctcgccgtgccggccgaagtcgtgccgcaacgcctcgcgcagccggggcgggatcgcggcgcgctgcggcacccgcgcgtcggcgaggtcgaccacgtcgtaacgcccgacctggacgctcatcaggtacgtcgcggtcggctcggtccgctcgtacacccaggtggtggtgcccgcgccgcggcggcgggcgaccaggtcgccggtgaccagcacggtgtacggcgtcgccgtggtcagcgtgaccaggaacgtggccttgtcgtccgggcggtcgttgcacgggaaccaggacggcgcgccgatcggctggctggccaccagcgccccgtcggtcagctcgtcccagccgatgtcaccccagcggccggcgatcggcaccggcttgccggagtaacggatctcgatccggaagacggcgccgtgcccgaccgcctgctccggccggatccgcagcttgtccggccggtgggcgaacttcgccggccgcccgtcgacccgcacgtcctgcacccggagatgcccgaggtccagggtgaaccgggacagcggctggaccgcccgcgcggtgatcaccgccttcccggcgatccggttggacgtgacccggtagtccaggtcgaggtcgtagtgcagcacccggtatccgccgttgccgtggccgggcagatacgggtccgtcgaatactccgcgcccggctgtgccgccggggtcatggccggcgggaagccggcgccggccaggtgccgatcgggttgccgagccagcggctgtcggcgggcaccgcgtcgccgcgggtgaccagcgatccggggccaaccgtggtgcgggcgccgatgctcgcgccgggcagcacgatcccgttgggaccgagcgtggcgcccgcgctcagagtgacctcgtccatggccatgatccgatcatggaacaggtgggtctgcaccacgcacccccggttgacggttgctccggcaccgaggtgtaccaggtcgtactcggggagccagtacgtctccagccacacaccgcgaccgatccgagcacccagcgtgcgcatccacgcggtcagcagcggggtgccggtggcgaaccggaacagccacggcgcggcgagcacctcgacgaacgtgtcggccagctcgttgcgccacacgaacgacgtccacagcgcccgctcggtcacccgcagccggccgaccagcagccacttcgccgcggtcgcggtcaacgccgcgacgatcaccgcgccgaacatgaccggcccggcggccagcgcggccgcccagccgcccccggcccgccagatcagcgccagcgcggcgatcaccagcacggcgagggcgccggcgcacatcaccgggacgatccggcacagttcgatcgcggcccgggccagcttcagccgcagcggcggggcgaaggtgcggctggcgtcggccgcctcgacggtccggcgcagcggcatgggcggggcgcccagccacgacgaacccttcttcgccttgtgcggcgccgacgacagcaccccgaccaggccgcgcttgggcaccgaccggccgggcgccgccatccccgagttgcccaggaacgcctgcttgccgatccgggccggcgccacccgcagccagccgtggctgagctcgtaggtggccaccatggtgtcgtcggccaggaacgccccgtcgttcaccgtggtcatcgccggcagggcgaggaccgtggagacttcgacgttgcggccgaccttggcgccgagcaggcgcagccacaccggggtgaacaggctggcgtacatcgggaacagcgccacccgggccatccccatcagccgctcggtggtccacacctgccacgccacccggccctgcacgcggtggaagccctcccgcatcccgaggctgaggatgcgcaccgcggcgagcacgatcatcgcgtacgtcagcagataggcgaccgcggccaccgggatcacgagcagcgcacccgccagcgcgggacggccggacaccccccagccgagcagcgcgaatgccggcagcagcgccagcaccggcaccagacccagcagctgcgcggtcacgctgtaggccaccacccagaacttggagcccagcggcgaacgctccggccgctgctccggccagccctccgcatccttggcggcggccggcgcggccggggaaccggcccagcgctgccccgacggcaccgcgcccaggaccgtcgaccccgccgcgatcctcgcgttcttgccgacccgggcacccggcatcagcgtgctgcgcgaccccacccgcgccccggcgccgacccgcaccatgcccacccggacgacgtcaccgtcgacccagtagccggacaggtccgcctccggctcgatcgccgcgccccggccgaccttcagcaggccggtcaccggcggcgccgagtgcaggtcgacgtcccggccgatccgcgccccgagcgcccgggcgtacgtgatcatccagcccgcgccggtcaccccgttcgccccggtcagctcggccagccgctcggcggcccacagccgcacgtgcacgctgccgccccgcggatagttgcccggtccgacaccgcgcagcagcatccgcgcgccggccgccgccaccgcgatccgcccggccgggctgaacagcaccagccagcccgccacgatccacgaccaggacacctgcggcgtccacgacgccgccacgacctttcccagcgcggcgagcacggtcacccagcgcagcccgaccagcgccagcatcggcagcatcagcaggaactgcgccagcccggcccgccgcggcgtcggtcgcacctcccggcgcaccgccacctgcccaccggccgcgcccagcttcacggccatctccgacagccgcggattctggtagacgtcggccaccgacgcctgcggccgggtctgccggatccacgccaccaactgcgccgcgttcagactgctgccgccactgctgaagaagtcggccgcggcatccgccgggcgcaccccgaggatctgctcccagccgtccgccagccactgctcggcctcggtcagctcggcgtccacgtcaccggcggtcgcgaggggccacggcagcgccgcccggtccaccttgcccgacgtccgcgtcggaagatcatcgaccacggccagcagcggtacgagcgcggccggcaactgctcccgaacccgctgcgtggccgcggccaggtcgaagccgccgtcctcccggaccaccagataacccaccagcagctgattgccggcggccgtccgcttcaccgcggcggccgcaccggccaccccgggcagcgcctgcagcgccgcgtccacctcacccagctcgatccgccggccaccgagcttgacctgctcgtcaccgcggcccaggaacagcagcccggccggctccgcgcggacgatgtcaccgctgcggtaggcccgctcccagcccagcgacggcagcgccgcgaacttctccgcgtccttgccggcgtccaggtagcgcgccaggccgacaccgccgatcaccagctcgccggtctcccccatggtcaccggctcgcccgccgggtcgaccacggccagctcccagccggccagcggcagcccgatccgcaccggcccgtcaccggtcatccgcgcggcacacgccaccacggtcgcctcggtcgggccgtacgtgttccacacctcgcgcccctcgaccgcgagccgttcggccagctccggcgggcacgcctcaccaccgaagatcagcaaccggacgtcctcgagcgcctccaccggccacagcgccgccagggtcggcaccgtcgacaccacggtgatccgctgctcggccagccacggacccaggtcgacaccgctgcgcaccagcgaccgcgcggccggcaccaggcaggcgccgtgccgccaggccagccacatctcctcacacgacgcgtcgaacgccaccgacagcccggccagcacccggtccccggggcccatcggctcggcaccctcgtcggcgaggaacagctgcgcctccgcgtcgacgaaggcggccgcggacccgtgggtgaccgccacccccttcggggtgccggtcgaaccggaggtgaagatgatccaggcgtcatcgccgggccccggccgtcccgcgcttccaccgggagtacgccgggtggacacgctcagcccgtccccgagcaccgcgctcacatccgcctcggcgaagaccagctcggcccgctcctccgggtcgtccgcgtccaccgggacgtaggccgcaccgaccgcgagcaccccgaggatcgccaggtagagctccgccgtgccggacgagatccggatgccgacccggtcaccgaccccgatcccgtgcccgctcagcgtcacccgcaacgcctcgaccgcgtcggccagctcccggtaggtcagcaccccggccccggtgtcgatcgccgccgccctcgggtgcgctgtcaccgtcgcgtcgaggatgtcgagcagcgtccgccgcagcggtgccgagtcggaccggaacagcgccggcgcctcgtcgggaacggcggcctcgggaagctcgatcagtcgcaggtcactggtcacggtcaccgggcggggctccattctgccgcatgttcagcaccggcatggcgcacaggtctgagccgcccggggcagccatccaagttacggcgccgcaacggaagatgaccgccccatcacagaaaccgtgggcactgacacactcaagagcgaccaaaacgccatcttggcggcgagtacgccgccttgcgggtccagttgatcagttggcgccagcagatcagaatgcaggcgaggctgacgaggcggtcgtggatgtcgagtcggcgttcccaccgcactgcgagtcggcggaactggtgcagcagggcgaaagtctactcaacgacgtagcgcagcttgcccagggctggtgcttcgagtcgggtttaccgcggttgaccggcgacgggcctgtcccggcgcccctttttcgcgtcgatgtgactgccgtccatcgctgctctcgaccagtcgatccggttcgccgcgttcgacttggccagcagtggctgatgcacccggtcgaacacgccggcttcggtccaacgctgtagccggcgccaacaggtcatcccggaaccgaagccgagctcctgcggcaaatcctcccagccgatgccggtatgcagcacaaacgaaatgccatgcagacacatccggtccggggcaggccgcggtcccggagccttcgccggccacggcggcagtaccggctcgatcagctcccacaactggtcatctatgacccgcgttgctcacgacgaccgaacgagactgacggcgtcagttcgattggagaatctggtgacgaaggagattcaagttcgctcagccgtacattgacctcttcaattccgagactctacgtcgtcacccatcgaaaccatgacctgggcgctcaccacgccccaccgcgggtaccttctggaagacgcacgggttcaacgtcgatccaaaggccgcatgcccgcacatggacgattgacagcatcgtggggctggcgggccgtcaccatctatccgcgccggcacgttgctgactacatgcggcctgccctcgcccagacccggaccggggatccccttgcacgagccaccgtcggaagctgcggatcgccgctaccgcggccgccgccaccctgccgatgcccggcgccgccatggcgaccaagggacacaagccgaaaccagccccgccggcggtgcgcgacagcgaccaccacggcatacccgacgaccggtaggggcgtcgggatcacctcagtccccgttggcatgacggcgttcagcatgctggagtagttaccacgccctcgctgaccaggaatcgggcgcgctttcgatcatggcgccgatcgagcatcgcaaaggtcagttgtgctcgtcgccgaggagttcgctgatcgggggatgcgatccttcgacgacgtggattagcgggtagtaccacggctgggtgcggcttacgtccgggtcctgccaaatcgactttcagccgtagatatcctcggctgcgcgctgcgaccacggttcagtcggacggtgtcggcggttggttgctgtgcggggccatacgcagagggtgaggatggccaggatcggtagtagcgacaggatggccagcggctcggctccgaagagtacgaagcctccccaatacaccgacgggccggcgccctggcgatgggtggcggccgtcagggagccggtcgaggtcgggatgttggctaagcaggccggggccagcatgaccagcgtggttaagcagagtatcgagtaggcggtctgcctaccccggtcgtagcgtcgcatgcgctgcgaggtggaaaacccgagcagcgcgccgagcagcatgccggccacgcctccggcgatggtgtcgcgcagttgaccaggtggttcggcccacatcaggatgaaactcagggctggctcctggtccgggatgatctgtaccgcggcgaggtatcccgcacgggtgcccgacacctcggtcttcgacggagtgtccgaccagtgccggtcgacggtggtgcgcacgtcgtgccagccctgtgcgcgcatctggtcttcgacggcggcggcgatctgctcagagcctgcgttcgggggcatgatgccgtcgacctgggccgtgccgacccgtacccccgtgccgccgtgcaggctgtggttgctgtacggattccagaaggtcggccgctcgtagtattcgactttgtggccgaaggcacctggcaggaccgtgaccgccatcccggccgccgtggccttgtcgggcgccagcgggtcgacggtgcgccaggccagccaggagccgagggcgataccgctgagcccgccgagcacggcggcgattgccgcgacgaggacggcccgcaacctgaatccggcaacccgccggcccgagctgtacgggatcggcacggcggtcggccagagctggtcgaccgcggcgacaggtggtgccccggagttgaccgggaccgctttcatgtcatcgcgcatgcggcaccccttcggtgaatcacggctcggttgagccatacaaccgcgctaccaggcaagacgcggccgacgatacctaccctgcgcaccccacccagcggtcgatggcgtgtcacggcgtatctgctcaactcggaccgcgagccgatggccatagcgatgcaggagccggctcacgctggccaggcgacaagcacctgcgcggttcgtacaagcgaactaattcatgacggtgcatgtgaggcgtaggcgtaggttgcgtggccaggcggctaactagaggaagtgaggtggcgttggtgttcatccgccggtgacgcggtcagtcgatatccgggtggcgactgggcgtcgacgatgcgggttctcgtccaagcatcggtggagcgatgatctggtgcagcgcaactgcgcacccgcccgaccaggtcgattaccgccgcggtgtgagtgtcctggtgggtgtcgaccccgccggagacctcgatcggggcgccatcaggtgtaatggagggcatcgtcgtcctgtcgttcgtgactggggcagggcggcacgcaccagccgggcaacgcggacaagacagagatggggcctctggccaggctcctatgaagtcataacgccacgtccagtgagtgcacgagcaccttccggccagggccgacgaatcccgttgaggacccgaagtcagtcaggcgatgggtcaaaccctggccggaggtgctcaccaacatcatctctgtcaggcgggcaggcgcaccgcgaagacggtcaggggttccgccgggtcgctcacgacgatgctgccgccgtgctgttccaccacggcgcgcgccaaggtgaggcccaacccggagccgggtatgccgctgtgccggacggcgtcgccgcggaagaacaggtcgaacacgcggtctcgctcgtccgcgggaatcggctcgccggtgttggacacactgagcacggcggcgtgtgcgtcggcgcgcagggtcaccgcgatcgcagagtgctccgccgcccagatcagtgcgttgttcagcagttcgtcgacgacctggcgcagccggtcccgatcgccctggatcagcgtcgtggcgggagtgtcgacctcgatggtcacgtcccggtgtgcgcgctcgcgcgccgcctccaccgcctggcgcacgaccgcggccaggtccatcgtccggcggtggacctcgaggtggccggaccggaggccggccacgtccagcagcttatcgacgatgaccgtgaggatgccgacgttgcggtgcaccacccgcaccatgtcgcgatggtcttcgacgaggtccggctcgtcgagcaacagctcggtgtaggcctggatcttggtcagcggcgtacgcacctcgtgaccgaccagcgaggcatactcgttcctgatgcggtccagttcggcggcgaggccggcggcccggcggcgttcgaggaatccacccagctgcgcgccgatcccggtgaggatcgcggtgcgggtgtcgtcgggcacctcgggcgtgtcgctggaacagaccagcacacccagcacatcggcgccgctggacaccggaatggccagcgcggcgcgcagcggtgtccggtcgtcgccgagctcggtcgcccagagcggctggttgctccgccaggcccgggccgggagcccgccgtcgggcggcagcggttcgccgtccgtgcaggaccagccgtgaccgtcggccgcccagcaggcggcgcggcgaaggacctgcccgatctcgtcgacgatccagagctccgtcgccgcccagccgatcatcgaaccgatgacctgcaccgcgtcggcaagcacctcgtcggcaggctccgcgctcgcgaggaccgtcgaggtccgcagctcgcattccttcaaccgggcggcgcgccgcagtgctgtcacgtcgttcatcgccaccacggcgaggacgtcggcacggccctcgatcgggcgggcatgcaccaggaaggtccgcgccggggcgtccggcgtgcgcatgacgacctcggcgtcgcggacgtgttccccgcgcagcgcgctgaccagcgggttgcccgcctccgtcagcggacgcccggccgggtcgtgcaggtgcagccgctgcggccactgctcggcgggggcatcgtcgagccggccgccggcgagcgcacgcgccgcgtcgttgcacagcaccggccgtccgacgctgtcgcagccgaacaccgcggtggtcaggctgtcggcgagcacctgcatggtctcctgctgctgttgctgcaactgccgccgggccaggatctcggcctccgcctgcccgatgcgccgggacaactcctcggtgagccggcccagctcaccgccggcggtctgggaaaccatcagcgcggtgacgtcctccggccgttgcacgatgtactgcagctcaccgtgggcgttgaccagcggggcgtgcagcggcgcccagtaccgggtggcgaagccgccgcccggctgcgggacgtcgtaattctggatcggcatcacgtcgggggcgcggtcgcgcagcacccgctgcagcgaggcgttgatcgcctggacgccgtcggcctccgggtcatcgggattgtcggggaaagccgcgaagatgtgccgtccgacgatgtcctcgcgccgggtgagggtggccgcgagataggcgtcgctcgcctcgacgatcaccaggccgggatcgaggaccagcagcggcgtcggggcgcgccggaacagcagccggtagtcgatcacgcttcaccatagtaaagatgagcaggctaaatccgatacttcccggaccgctgtcctaccctgagcgggccaccaggaagtcctctccgctggagggccggaggccgtccggacgaccggcgaaataccgctcagcgaggtcggcggcggacacgtgccgaacctcgccgaaccccatacggctcgcgatgtcgagcatctcagccggtgtgtagaaactgacgaagggcgtgcgcgaggcccgtgcgcccgccgtgctcgcccgcaggccgggccggtcagcctcgtccaccaggtcgaccggcagcaggaacgtcatggcgaaaaccgaccccgccgccagcccggccacctgccgcagggtggtcgccgtagcctccctcgtgagatacatcgagaccccggtggagaccaccaccgccggcctgccgacgtcgaaaccggccgcgaccagcggcttcagccagtccgcacccacctcgaagtcgaccgggacgaggcgcagccactcgggcacgccgtagcccgcctcctgcagacggcgtcgtttccactcctgaggccccggccggtcgatctcgaagatccgcagccgcccgcccagctccggacgacgctgggccagggtgtccagccccgccccgaggatcacatactggctgacgccacgatcggcctgctggacgacgagatcctcgacgaaccgcgcccgcgccaccatcccggcccggaacgtgcgggtgaattccgggtccatgtccggccgggcacgccagtcgtcgcccgcagcggccagtgcccgcccgaccgtgtccgccagaacgtgcggcggcgcgtcgagctccacgtgcagcgcccgccacagcgcggtgcgcaccgcggtgccgtccatcagggcttcccgctggcgggtgcctgcagattccacagccgcccgtccggatcgcggacgatcatctcccgggtcccgtagtgggtgtcgctgaacgggctgaccacctcgacgaccggatcgagggcgagcgcatccccgtccggcacgcgcagcacgatccgggtggtcggctcgcggtcctggggcacctcggcgatgaacacgtacgccccgtcgccgttgcgcagttgcccggagttgtggtcggtggagaattccagctcgtagcccagagactggaagaacttggccgcccggccccagttgtgcgtctccaggaacacggcctcgatgccttcggtcgccatcagatctccttttcgtgcggcttgtccaggtaggcgcgcagggcgtcggcgaccagcgccgacagcgacgagccggactcgacggcccggagtttgacctgcttgatcagctcgaccggcaggtacacgttgaactgtttgacgtccgtctcacccacgacccgatgctagcatgctagcaagctagcgacgccggggcgagagtcgtgtcatggcggccagcgtgacggccaccgcggcgagaacaccggcaaccggcgcgcgctgcacccccaacgccagcccgcaccacaccccgacgaacgtgcccgccgccgcgagagagtgactccagcccaccatctgcgcgagaagatggccccgataccgggcctggcgtgcggtcgcctggagcaccgcggcgccctggacggccgccgcgaaacacaccgtgagcaccagcatccctgcgaaccgaaggccaccgcccaggccaccagtcagcgcgagcccgcagacggccccgagtgccgcgatccgcgcgacgagcagtacgcgcagcggtacaccccgggcgaggtacgggcccaccgtggcgccgacaccgctggcgacgagcagggcggtgagcgccgcactgggacgcggcatcgcctgggccgcccactgcgcgagatagccggcgacaatgctggccgagcaggccagcagcccggagaccaccgggctgccgggtcccactgctctgacgatgtcgctcagcgatgcacgcaccgacctgctctccggtgcggcctcaggcgggttcaccgcgatcgccgcgagggtacgcaccgaacggcggcgcagcagaagtcccgccagcgagcagcacaggttgacgccgagcgcggccggcagcgccgcggccgcgagcaggctgcccagcggcctggccatcagcgacccggagactccgagcatcgcgtacaccgtgatgttgaagcgcaccgccgctccgtggctgatccgcgcgatctccccggtgaacagctcctcggcgacgtcgacgaacaacggaacaaccgagacgatcagcacgtacgcgacgaagacgaccgccggccggagcggtgtcgtccagatcagtgcgagcgcgagggcgcacgccaccacatcgaacgcctcgcacgccaccagcacccgccccgggtcccggtcgcgcagcagccgggcgacgaccgggctgctcatgtcctcgatcgtctcgatgctctggatcaccggaagccagacgatcggcagcaccccggccgccacggccccgggaatcacgccggcgaccacgaacgtcccggacagcgacgccagcagacccgcggccatccagcgtcgcacccggcggaacgtgtcgggcggctcggggctcaacccaggaagtcgagcagggcgccggcgaccatccgtggcgcggtgtgcgtcgcgaagtgcgactggccggccagcgtcacccgggtgacgtccggcagggtggccgccagcgcctccatcgtctccggcatcggcgcccaggtgtcgctgccctgcagcagcagcaccggcacaccggtcccgccccaccgcccgacgtcgagggtgtcgtcgaccatcgcctccaggtcgtgcaggcagccgaccatctcggccggatccggcggcgcggccccggccagcgcggcgaggatcggcgcgggcacccgggacacctgctcggcgaacagcaccgccgcggccgcggggtcgccgtcgcgcagcagcttgcgatagaggtccagggtggcggccagccccgccccggccgcgaacagcggcggctcgaacaacgccagcgaccggacgcccatcgcgtccccggccgccgcgtgcagcccgaccgtcgcgccgtaggacgcgccgaccacgtgcgccgacccgccggccgcggcgatcacggcccgcagatcggcgacatcatcggcgtacgtcttcgggccgccggcgcggtcactcggcgcgtacccgcgacgcgcgtagacccacaccgcgaaccggtcgctcagcagcgggtggaccggatcccacgaatccagcccacccgccgaaccgtgcaccaggacgaccggttcgccgcgcccgatccgccgcgcgaccagccgggtgccatcctccactgtgatctccacccgccgagtctggcagccggggccccggccatctccgcattttcaggcggcggtgccgatcgggttgagaatggcgagccgccactcaccgtcgtggccgcggcgcaccacgttcgtcgtcgtgccggccgcctgcgcccgcccgtccggggtgtccacctccagcgtccagtcgatcagcatcagggcgacgtcgccgctgctgaagatgtgccgcacggtgttcaccaggtgcgggcgggcggacagcagcccggccaggtcggcgcggatcttcgccgggtcggtgagcacctcgccctgcaccgtccggctcaccgcctccggcgacagcaggccgagcaggccctccaggtcgccgtcgttgaccttctgctggaacgtgccggacatgtcgaaaggggtcatgtcgctgtctctcctcgtacgctcggaacgcttccttccggctcgaacgctacggttgcggcggctcggtgcctgtggcgaaaggtgacaccggcttgtgactatcggacatgacatctggcaggttgcgtacgatccgcccgccgggacggagaccttgccgatcgaggtcctctccttcgcggccctgcgccgcatggaccgcgctcaccggcgcacccgggtgcagcggccggcattccacatcctggccatcgtcgagtcgggcgagggccggcaccgggccgacttcgtcgaccacccgctgcgtcccgggacgatcgtgtggatccggcccgggacggtccaccgctggacggacgtcgaagccgtcgacggtccgctgatcctcttcactgcgggcgcggtcccggaggacccggccaccgccgtctgctggcagacgaccggcgccgacggagacctcgcccgcctcgcagccgcccacctgaccgccgagcacaacgcccgaccagcctcggcggcgatcctgaagctgctgctcagcgccctgctggcccgggtcacccggaccgctcccccggcgccgggagagcccggagacgtcttccaccgcttccgggcggcggtcgaggcgcatttccccacccaccatcaggtcgcctggtacgcccgtcatctgggctactctccgcgcaccctgacccgggccacgagcgaggcgaccggggtcggcgcgaaacggttcctcgacgagcggatcaccctggaggcgaaacggctgctcgcccacaccgacctgaccgtcgtccggtgcgcccaccggctgggcttcgccgaccaggcgaacttcaccacgttcttccagcgtcagaccggtgtcgcccccaccttctggcgactgaccgaatcggccggtggggcgcccgccggttagcatcggctcccatgcggacagccacctgtgtcgaggcggatctcgcctcgctggagcgtcatctgcccaccggtcgcaacaatgcccaggcgtaccacttccagcggcagcagaccggcgagatcgactacctgatcgcctggctcgatgacgtcccggtcgggcaggcagtgatcacctgggccggtttcctcgacgagcgcgtccgcgccgccgttcgcggctgccccgagatcggctggctgggggtcgcgccggcccggcgtggcaggggcgtggggatcgccctgctgcagtccgcggagagccgcatcgccgcccgcggattacggatgtccggcgtgggcgtggcaacggacaacccccgtgcggctcgcctgtacgagcggctgggataccgggacacgtcgatgagcagcgagtcgcgctacacctggtacgacgacgcggacatcggccatgacatcgtcgagaccactaacttcctcgtcaaggacctatgagcgatcgccggcgcggaaccggcgccacaaccggtccggcagttcgcggtcacggtcggagattcccagcaggctgaggatgtcgaacgccgcgaggtcggcgtcgcgtgcggccagcgcggcgtggacgtcggtgtgcgacacgccccggaaggcgttgacgcgaaggaacagtcccccggaggtcagcggttcacgtaagtcgcgaggccgccgagttcctcgctggcgatgaacaccgaccggacgttgatgatcgcttcttcgacgtggaccggacacccccaggcggagtctccccacgagtccgcgatcttgatttcggccggctcggtgcagccggacgcgccgccgagctggcagttctccgggtgcggtgcggccccctgggccgccgcggcggagcgcatccgggcggcgaggtcggctgccgccgcggcccgctcctcggcttcggcgcgcagttcgcgctcggcgcgtaccaccttggcaagcgcgtcgtgcgcggccctggcccgcgcctccgcctccgccttggcctgttcgatgtggtgccgttcgatggcgagcgccgccgtgccggcgaagatgcggttcagggcaagatcggtctcttgcggtacgcggggtgtccggtggtacatcgcgaaggtgcccagcaggctgccgtcgcgggccaggatgggtgtcgaccagcaggcggcgagtccggcgcgaccggccaggtcgcggaagtcggcccagaacgggtcggtgccgatgtccgtgacgatcaccggttcccgccggtgcgcggcggtcccgcaggagccgacgccctcaccggtcgcgatcccgtcgatcgcctcgttgtagaaggcgggcaggccgggcgccgccccgtgccgcagatgacgtccgtccgcgtcagcgagcagcacgctgaccagcacttcctggggggtcaggcgttcgatggtgcgggccatcccgtcgagcacctcggccaggggcgcctgcagggcgatctgctccagcagcgcccggtgttcggcggtcagccgctgcgcctgcttgacctgggtggtctccacgccgatcacgtgcaccccggcgacccggccggcggcgtcgcggcgcggctcgtacgtgaagtcgaagaaggcctcccgctcctgggccccgcggccgagcaccacccggacatcccgcccggtgtaccgttcaccgctgcggtagacctcggcgagcagctcgatgaacccctggtcggcgagctccggaagaaggtcgacgagcggatcaccggtacgcgggggcgccatcccgatcgcggcgaagaaggcggggtcggccgcctccacccggtgctccggcccgcccagcgaggcgaacacggcgatcgactggccgaacagcgcccgcagatccccgtccacacccggggtggccgactgctcgtttgaaaccgccgtcatggtgccgcccctcctcgcccgcccgcgaaccgcaccaacctaccgaagtcgcgccgcagcggcagcgcgacccgcgcctggcgggccgcgctgccggaaactcgcggtcagccctcgatctgccggggcccgctgccaccggtgccgatggtgattctgcgaggcttggccttcgcggagatcgggatgcgcagcgtcagcaccccgttgtcgtaggttgcgtcgagatgctcggtgtccagggtgtcgccgaggaacagctgccggctgaacacccccatcggccgctcactgatcaccgtctcgacgccgtcccggctctgccgctgccgccgtgcctggacctgcaacacgttgcgttccacggtgaggtcgatcgagtcggggtcgacgccgggtagatcgaagtacacgtagaaggtgtcgccgtcgcgctcggcgtcggcgtgcatgaccgcgggccggctgctggtgccggtgagctgctcgaaaacgcggtcgaggtcacggaacgggtctgtacgcagaagcatggtcctcctcctccgccattccaaacttgagcccccgaggctcaactcaggtccaggtttactacccccgggcgccctcgtcaagcccctctgagctgggattatgcaacaggcttgacagcgcgggactcccgttttatcggttaagagcggggttttctccccacgaccgttccggaggtgatcatcgatgtggtcgttgccgccgaccgtcgaccggtggatgctgcacgtcgccgccagcccgcacgaggtcgacgaggttctcgccgacctgtgcctgcaccagcgcagccgcgccgtcaccgaccccgacttcccggcctgcctgatcggtccgaagaacctgggcgaacccccggcctggatgcggttcgcccgcaccgaactcgaccggctcggctaccgcacccgctggtgcgacgtcggctgcgtccaccacccgctcccgcagcgcatcgcctccctggtcacgctcggctgatcggtcggatcagcgtggcggggcggctgccgcagcgcggtgcgccgcaccagccgccggtcgggacctacaccggattcgccggggccgcacacgattccttcacgcgcgccgcttgcagcgtgaagatcgcgcagatggcgatgaggacgagcgcgcccgcgaccggggccaggccggcggcgaacgcgacgacggcacagccgtacacggccaggttggcgacgacgaccacctggttcgcccacgcccagaggggcaccggatcgaccccggccgatcgctccaggatgccccgcaacacaccgttgatcaggccgtacgtcagtccggcgccgaagaatccggcgaacgcgcccggggtgccaccgaagacccacgccacgatcgccagcaggtagccgccggccagccacggcagcagccgttcccgtccggtgacgaggcggcgcagcgccagcgtcgcgaaccccccggcgccgtagcaggacagcgcgtacccgaacatccgcgagtcgaagtggtgcacgagcgtgaacaccggcagttcgaccgcgttgacggcggcgccggccaggctcagccaggtccaggcggacgcgccgccgagtccggtcggacgggccagcagtctgcgcagcgtgaacagcgccggctgagccggcgcggcaacggccgacccgccggcggccgcaacggtggcggacggaacggtggcacacggaacggccgcgaccggagcggtggcggcaccatcggccgcggacgcagcggcggcggacgaagcagcggcggccggagcggtggcgccccgagcggccgcggccgggccggtggcgaggatggccagcccgagcaggaagctgatcgcatcgatgatcaccagccagcgtagccccagggtgacggcgacgaccccgccgacggccggtgacagcgcgagggtcaccgacccggccgccccgatcgcgatgaaggccgccgtccgctcaccggccggcacccactccccgaccagcgccatgaacagcggattcgcgatgccgcgcagcagcgccgacagggcgaagaagatcagggtgtacgtcaacggcgtgcccacggcgagcgacaggctgagcgccgcgagcaccacctggctcaggttgtagacggcccgccgccgccgtgccgggatgcgttccaccaccgcccgcacgaacagcaggctcggcaggctctgcgcggcgaacgccgcggcggtcgcggccgatccgtagtgcgactggaccagctgggcgagcccggtgaaggtcagccagttgccggtctgcgacacgaacgacgcggccaccagccgtcgcgtcccgggcgaggtcaccgctggacggcgtacgtgtatcgcggcgcgggcgccgggtcggtgcgcagccgggcgtgcagttcgacgtcgtaccgctcaccgtcgtacgccagtttggctctttcccgcccttccaccagaaatccggcgccgcgggcgacgccgcacgagcccgggttgtcgacccggtgccccagctccaggcggaacaggccgagctcggcgaaggcccattcggccagcgccgcggtggccgccgtgccgaacccgtgcccgcggtcggcgcgggtcgtccagtaggacacccagccgaccgagtgccgccggtccacggcgctgaccgcgacgtgcccgacgatccggccggcatacgcgacagcgaacggatgggccccgccggcgttgcgccagtgggtgatccaccgccgggccgcggccgggtcggtgatcggttcgccggcctgggtcgccatgtcgggggtggcgaacgcggccagcaccgccggtgcgtcgtcgtcgcgccacggccgcagcagcagttggtcgattccggacacgaccagatgatccccttcggaggggccagatcgcaacctcagtgccagccgcagtcgccgcagttcgagctcccgctcccggaggccgggtggcggaacgactggaccgcgaggtaaccgagcagaccgcacagggccagcacgacgaggccgacgacgatcgcggtggccatgacgcgacggtgggcgtcccgcccctgtccggtgtcggtgcgctgttcgggccggacccgcagctcgccggaggccaggccggtggccacccgttccacgccgtcggtgtcgaacatcagggtgccgggcgcaccggtgccgtacagcccggtggccgggccggtctggcggaaccagcggtcgacgccgtgtgcggcggcgacccggcccacttcggtgtcccggatcgtcggccagcggcggcgcacctcgtcctcgggcatccagcgccgcggcggtccggccggcggctcgtagccgcggggcaccggctcggcgaccggttcgggtgccagcgccgaccgcagtgcccagccgaagtccgggttctgccgcaggcactcgtcgagggccgcgatcagcgccgaccgcccctggtcgtcgccggcgtcgtcgagcagatgctcccggccggtgtcggccagttcctgccggaccaggcgccgcaccgactcctgccccggcagcgcatcgacgatggccgcgacctcaacgctgtcccccatccctccatccgagcacacggccgccaccacgcccgttgcccgccggcgggacgtcgagatcgacgaggaaaccccgggtctgccactgttcggcgggcagccggtcgtacgccagccggaagtattcctccgggctgagaatgcgcctcgatgagctgcgcccacatctgcccgtcggtgtcggccaccatgctggcgtgggccgcgaccccccgcagcccgattccggcgggcacctcggccggctcgaaccagcgcagccgcaccgccgtctcctcccccagcgaccagccggaatggggatgagcggcgtcgaggagaaccggccagagcatcgtggcatcatgtcatccgccccggccggcccacgtcatggattcatcgcccggatcggcaccccgacgtcgtcgagggcgccctccagccggagccgctccagctcccggtcgacgccctgcagcgtctgcaggtgctcctcgatgccgaggcaccggcaggccagttcgaggcgggcgtcgtaggcgcgcagcaccgccgccagcaccgcgtccgatcggcggatgtggtcggagcgtcgcatccggtccagccggcgcaggtcgaaggcgacctgttcgagcggaacggcgggcagggcggccaccgcgccgctgccggagcggtccacgacccgcaggcgccgcttcggcggatgtccgccgcgcggtggggcgatccggcccggtttccgggccagcggcgacccgccacgggaccgggccggccggtgcggccggtgcgggaccgccgtcgaccgggtgcaccaggcgatcaccatggtcaggaaccggcgccaatcccagcgccggcgtccggtgatccgggccagtcgccggtcgacggtgtcgtcgctcagccgccgttcgatcagccggtcgaggtcgccgacccaccggtcggccagccgttgctcgatcgcgctccgctcgtcggcggattcgccgtcccaggagaaccgcatcattcacctcctcggccggtcaccggcgattcgaggatcacggcgaccgcccggcgtgcggcccgcaggttgctgcggacggtctgcgggtccttgccgatcagccgcgcgatctccgccgggggggtagccgtccagccggtatgccagcacttcgcgctgggccggcggcagtttcttgagcaccgcgagcaccccctcggcctcctcgtgcagcgcgctgtccgcaaggtcgctgtcggcggtgcgttgtccccgcatggccagcagcgcgagccggcgacgacggtcgcgccgccggatgccgatcagcgcgtggaccgcggcctgtcgtacccaggcatcggggttgtcgatcttcgaccagcaccggtaggccgagctcatggcgtcctcgaccgcatcctccgcgtcctgcagcgtggcatcctccttgatcatcagaaagcgcaccagctccgggaaacggccccggaagaacagttcgaattccaggatctccccgtacgcgggcagcccccgcagcgcggtgagccgttgccagagcgtcacgacgtcgtcctcaccggcggggaaaggcctggacggcggccagtccgagggtgaccaccgccgcgatcaccgtgaccggcaccgactgggtgaacacgtagacgcccgccacgctgctcggcgcgatgctgcacagggctacggcaggactgacggtgcggtctctcgcacgttgacgggattccacgggctgccaccttccggatcgtcgaaccgcgggtgtgtgctgacgtccgtacagggtcagcgtgggcgcgcggcgtgcaagatcgccaccgacgggtgaccgggcggtgtgatggcggcgactgcgcggtggcccggcgtacaccagaatcgggtggtgaatcgacccgccgagagcctttcgccagggcagttgctgccgctggggcgccgtttccggatcgtgctcgtgctgggtttcctgaccgcgctcgggccgctgaccatcgacatgtaccttccgtcgctgccgacgatcaccgatgacctgcacgccaccgcggcggcggtgcagctgacgctgaccgggacgctggtcgggctggcgttcgggcagttgctgatcgggccgctggccgacgcggtggggcggcgggtgccgctgctcagtggcatcgccgtgcacgtgctggcgtcgatctgctgtgtcgtcgcgccgaacctcgcggtgctggggtcgctgcgggtgctgcagggtctgggcgccgcggcggcgaccgtggtggcgatggcgatggtgcgggacctgttcgacgggctggccgcggcccggctgttctcccggctgatgctggtggtcggggtggcgccgatcctcgcgccgaccgtgggcgggctggtgctgacctgggcctcgtggcgcggcgtgttcgtggtgctgaccgcgatcgggctggcgatcatggcggcggccgcggtggtgctgccggagacgctgccccggcagcggcggcgcaacggcgggttgctgggcacggcgcgcgactacgggcggttgttcaccgaccgggtgtatgtcgggctgatcctggtcgccggcctggcgatggccgcgctgttcgcctacgtcagcgggtcgtcgtacgttttccaggacgagtacgggatgagcgagcagcagttcgcgctgatcttcgccggcggcgcggtcgggttgatcggggcgacccaggcgaatgtgcggctactgcgccggtggacgccgcagcggatcctgagcgggtcgctgctggccgggctggggttcgcggtcgtgctgctgatcctggccggcaccggagccggcggcctggccgggattctggtcccgctgtggctggtgctggtcatggtgggtttggcgatgccgaacgcgccggcactggcgctgtcccggcacggtgaggcggccggcaccgcggcggcgctgctcggtgccgtccagttcggggtgggtgcgctggccgcgccgctggtcggggtgctcggggtgggcgcggtggcgatggccgtggtggtgttcgccggcatgctggccgcgaccctggtgtgcctgctggtggtccgcccgcaccggctgccggtggaggatgccgagccggcgatcgcggtcgtgcactgagcgggccggttcggggtatggggcgggtgtgtcgacgacaacgtgggtgagggcggccgcggccgcgcgggtggcgtggggcgtggcgctggtggcggcgccgcaccggattccccggtacggcgccgcgccggccgtggcggtgctgcgggtgctgggtgcgcgtcagatcgtgcagggtgcggtgacgctggcccggcccacgccgctggtgaccgggtgcggggcgctggtcgacgcactgcacgccggcaccgatctggccgcggcggccgggtcggcccgctggcggccggtggcgctgcccgacgcggtggtcgccctgggcttcgccgcggcgggctggtggctccgcgacgcggcctgatcccggccggtgaccgctcttcggaaccgacgggcgccaaatggctacttagggtagttgcaaagccgccgtgagtaactggccgtccggtaagtcgggcgtgccggaatgcgccttcaccgcactgtgacctgggggtatagacggcgatcggtcaatttcgtcataatggcgggtaatcgcccaatcgtggctccgtgcccgatgtcactgtgcgaggcggtgacggccatgactgaccgcaaaccatccgtgcgacagcgcccgatcgacccggcgctgtgccatctcctccgggccatagccgtgtcacatgcccgcgtccggcgcctggtcgccctgcgcatcgtgatctccgcggtgctcgccggggccggcctggtgaccgtcttcgccggcgcgtccaccgggaagccgctgagcgtcaccctctccgtcgtcggcgtgctgtgggccctggcgtactccctgggcctggcctcctgggcggaccgggaactgcaccgggccgcgctgctgcaggagtcgttcgaggtccgcttcttccagctgccgtggaactgcatgctggccggcgaggagatccccgccgaggacgtccggcacctgagcagccgctaccggggcgacccgccccgcgacacgtacgagatgccgaacctgccccgccccttcgacgtgctcgtccgccagcagcagaacctgtcctggggcagccgggtccggcaccgctacgcccaggtggtgatgttcgcgatgagcggctgggcggcgctcggcctgttcaccgccatcgcccgcaactcgaccatcaccgacctgttcgtccagtggtgcgtgccgtcgctcggcatgttcctgctcggctgggacaccttccgcgaacagcgccgggtcgccgaggaccgcaaacgggtgtgcggcaactcccgggggcgctgcctgcaactggccccggccggcctggacccggtggtcaaccaggacctgtgccggatggcccggcaggtccaggaccagctctacctgtcccgcagccgggcgccgcgggtgccgcgctggttcttccagcggtattacactcaggacagttccgacttcaccgccgggctggccgaggcccgcaactccctgctcacggccggcctgcacaaccgtccaccccggtcgccgcagcggccctgaccgcggccgtgaccacgccgcccggccggagtgatcattgccagtcgccgaggaccagccggacccgggctcgtcgcgggtgctgcgcgccctgctcaacggcacgttcgtgcccgcgatggcgccgaggctggcgaccgcgctggtcaccgtggtcgtcgccggcttcgtcattctctcgctggccggcatcgcggtgcgcgccgacggccccgggccgatcgtcgcggcgctggcctgcgcaaccccgatcatcgcgctgcaactgggctacttcggccggctccccgccaggcccaccggtcgggccggtcatctcgccctcgccgtgcaggccggtttcgtctgcctgccgttcctgcgcttcggcgtcgcctggctcagcttcgccgggctgctcgcggccggtgtgctgttcaccctcgcgccgaaggcggccgtgccgctgttcgtcctgatcgtggcgggcgcgggcgccgtcgaggtctggtgcgccgacgcgacgacggatctacccttcgccgtctcctacgccgtcgtctccaccaccctcaccggcctgatcgtctacgggctgacccggctggcccgcctgctggccgacctgcacgccgcacggcaggacctggtgcggatggcgacggccgaggagcggctgcgcctcgcccgggacgtgcacgacctgctcggcctcagcctgtcggcgatcaccctgaagagtgaactcacctaccggctgatggacgcgcatccggaccgggcacgccgggaactggccgaggtgctgacgctgtcccgcagggcgctgtccgaggtgcgcacgatcgtcgaccccgggcgggaaatttcgctggccgacgagtgccgcaccgcgcaccgcctgctcaccgcggccggcatccgggtgcgggtggtcgaacagggccggccgcccaccggccgggtcggcaccgtgctggccacggtgctgcgcgagggcgtcacgaacgtgctgcggcacactggtcatggaggcgaaggacgagccgacggcgctggagatcgccaaggccgttccggccaagggggtcggcggcgtggaggtccggccgatcttcacaccgccggcggcctgacgacggcgggccgcccggccggcgcggcccgggtcagccggcggccatccggatcagggcgttgccgccgagcagcagcacgtcggcggtggcgaccagggccatgctgcgccgcatccagcgggccgccgcctcgtgatcgtcgctggtgatgccgcgccccgcgaacagcagcgcggcaccgaccagcgcgatgccggggacgagcagcaggccgacggtgcgcggggtggcgccctgcaccaccagcagcgtgaccatcacggtcggcaggacgccgaacaggagcacggcgacaccgccggaccaccgtagtgcccgcaccggatccgtcatttccgttcacccttcccctcggccgcgggcatgccgaggcccacgaccggaccgccgatcacgcgccagtatctccggccgttgcggatcgccgcccggtagggtccggcaatgacctcgtggggcggcggcgtggctgggtcgtgatcgtggggtgcacggcgttcgccgttctgcacctctactgggcgatggccggcagtctgggcctgacctgccgttcttcgacgaacgggcctgtccgcatccgttggccaccctcctgcaacggacgccgctcaccggggctgggctcaagatggcttcagacgggctcttcctagatgccgacgtctgaagctgacggggcgtgcgccggaaccgtcatcaccgttgatggcggcctgggaagcgttgtcagacttttgggcagcatttcatgagtcggggcatcgccccagggtcgatgttgcgttagggttccttttcgttacgctgcgcggcgtgactatgtcgtcggtcgtcggttacgcccgctgtactgctgagtccggggaccgggagaatcagattcgtgtcctgcggaggctgggtgtgcccgcctcgcggattttgctggacgagccgttgaccggcgcgcggccgcgtccgggcctgcagcaggcattgcacatggttcaggccggggacaccctggtcactccgggtttggcgcggctggcccggtcgttgtcggatgcctggtcgatcatcgagcacctcgcgcagcgtcgtgcctgcctttccttggccgggcatctgcatgatccggcggatgggtcgttgctgcgcgatctggcgctgttcgtgcagttcgaggcggagttgaaggggttgcagacccgggagggcatggtgctggcccggcgggagggccgggtggccgggcgtgagccgaaactgtcgaccgagcagcgggccgagctgctgcggttgcatgcgtcgggcctgcatcaggttacgcagttggccaggatgttcggtgtctcgcgtcccacggtgtaccggttggtgcagcgtgctgctgagctgtccgcgtgaccgcgcccccgggccggcgcgttgacgagccggggcggctgacgtcggtctggcgtaccggcttggacgcggcggccgatccgctgttcgactggttcgccgacatggtccgtagcgttgtcggtgtcccggtggcgctggtgtcactggtcggcgacgaccgtcagttcttccccggggcgcgggggctgggccagccgtggcaggaacggcggcagaccccgttgagtcattcgttctgtcagcacgtcgtggccacggccgagccgctgatcgtcaccgacgcccgcagcgacgcccgcgtgcgcggcaacctcgcggtggacgaactgggggtgatcgcgtacgccggcatgccgttgaccgacgaggacgggcatgtgctcggctcgttgtgcgccatcgaccatcagcctcgccgttggaccgctcaggaacttgcgcggctggccgagctggccgccggctgttcccgggcgttgcgggcgcgcatcgcctcggatcaggcgcaggtgcagcagcaggcgggcatggagcgggaacggcgtgcccaggcggcggtcgaacgcagccagctgctgctgcgcgccagtgccgcgctgggtgcggccaccacgttcgatgaggtggtcgacacggtgcggactctggtgatcggcaatctggacccggtgtacgtgggcgtctccacgctggccccggacgggttcgtgcatctggcgtccggtcggcagctaccggagcggttcgcccgccaatggaagctgtacggcgccgaccagaagacgccgtccgggttggcggcccgcaccggccggctggtgtcgtttcccgacctggccgcgatcgccgaacagaccccggactcgctggcgaccttccacgcgctgggctggcagtcggcggccagtgtgccgctacccggcgagcacggcccggcgggcgcgctgaccatcgtctggaaacagccgcacatgttgaccgacggcgagcaggtggtgttgaccgcgctggccgggttcgtcgcgcaggcgctgcaccgcgccgccgcctacgaagaccagcgcaccgccgccaccaccatgcaacaagccctgctcagcactctgcccgaggtcagccacgtccgtatggccgcccagtacgtgcccgcgcagcagaatgatctggtcggtggcgactggtacgacgtgatcgacatcgatgagcagcgcctggccctggtgatcggcgacgttgccggccacggcatcaccgcggccgccaccatgagccagtaccgcaccatgctgcgcactctgctcgtcgatcacaacgaccacgcttctgcgctgctgcaacgcctggaacgcaccaccagggccctcggtctcaccgccacggccaccgccatggtcgcctatctgacccacgaccaggccggcggccacaccctgacctggagcaacgccggtcacataccacccacgctggtcctgcccgacggccggatcagtctgctcgcccgcggtgggcctctgctcggcggcctgcgcaacatcacccggcgcacccacacccggcatctgccacccggatgcctgctgctgttgcacaccgacgggctgatcgagacccggactcgcccgatcgacgacggcatcgcccgcctgcaccaactgctcgccgttcacggtggcgccccgctgtgcgagctggccgacatcctgatgaacgacaccaaccccgtcgaccgcgaagacgacgcctcactactgctcatccgcaccgctccggcgtgacctgccgcgccccggcgaacgctcagcgtagatgcccatcagcgtcggatagcgggaaggttgccggtctcagcgagaatcctcggccgactgcagacgtcagctcaccgaggcgggtggcgaggacacaccgatgtggcgactgagctgcacttgccatggggctccgtcgaccggatcaacgtgcgatgtaaaaaatatttgacttcagatgcggctgttccgtacggtcgtcatgtcaaatattttttacattaggggtcgtatgggcactgaggcgtcgcatccggacgacgacgaatcagtcccgttgactggccagcccaggtcttcgacctgcccctcgacgcggtcttcctgtaccagacgccactcgaccgacgcccggcaccgctacccctcaccgtcctggagcaccgtcatgaccactacgaaacgcatggcccggatcaccgggctggcctacctcggcctcgccctctccggcatgctcggattcctgctgatccgcgaccggctgtacattcccgacgacgcggccgcaaccgccgcaagcctcatcacacacgaacggctcgcccgcctcggcatcgtcgcggacctcgccatggtgctcgcccaggccgccacagcagtgtgcttctggaagctgttccgaccggtccagcccgtcgccgccggctcgatcgccggcttcgggctggtgaactgcgtgacgatcctggtcgccgtgatgttctcgaccaccgcactcgacgtggctctccacaacgacgcgacatcagcacaccaggcgctgctgctctaccacctcaacacggcagcgttcagcctgtcaggcctcttcttcggactgtggctgataccgatgggatggctggtgatccggtcgggctacatgccacgcccactcggatggctcctcatcggcggcggcctcggatacccgatcagcgtcatcacatcatcgctcgcccccgcccactccagcgtcgtctccgcgctcaccatgcccgccacggcgggcgagttgtggatggtgggctacctcctcatcaagggggtgtcggacgcggcaccgataaccgccgcgccaacagccggccctcaggcagcgctgccctgacccaccacccgacacaaccggtacgaccctatttccgacgcctggcgaccggctgctcagtcactcgtcggcgggtacatgtgtcccgtccgatgcatggcgatagtggacgcgacgacgagcacggcggacgctacgacggttacaccggccgtagtcgccgatcggcctcgcagccaggcgatcgcggcaatgctcgcaccccacggcagcaagcacgtcagtgaagtctcccagcccgctgagacgaagtctggaacggtcatgattgtcgcggccagcgatggcagcgtcaccaccgccgccccgaccgccaggtatccgggacgcttcggtgccagtcctgagcggccgcgggccggttcctgccacgccgctgcagcggccaagacggccgcggcggcggcagcggccatgacgacggcggccagcgtgacgaccgtgggcaggttctcctgatccaggccgtccacgcgtgccgtcgcggcgaggtcgaaccagctgcggaccgagaccaggccatagccagccacctgagctgccacgatgaccgcggcgacggctgccgggcgagcccatcgccagctggctgtcatcaccaggcccgcaacgatcagcgccagcaacagtggccacatcaccagcgggtagttccattggtgccgggctccggtcgaggtcacccattcgcccggcaccgctgccgcaagcgcgactgtcgcggcgagcaccacggtgcctatcccgcagaccgccatcttcaccggccgcggctcccgcggcccggatgccgcccggtcgagccttttcacgatgatgctcatgcggaatcaacgcaacgccggacaacgggaaactgttgcctcggccggctgtcatctacctgatcgggcaacgcggtggcgtcgccttgctggcggcgggctcggctaccggtggcctaccgcacgctgaccccaggtgtcggcttccccgcggatcgtccgccgggcgcatccagcggatcgaggcgccggcagcggtggccgggacccggcgaaagtgccagactgccgagccatgacgcttctcgacgtactgatcgagggcctgacggcggtcggcatcgacgagaagagcagcccgggcccttcgacgccggtcgccctgatcgccgcgcgcgggatcgtgctccgcgaactggaggaccgcctcccggcggacggcgacggaccgttcacggtcacgcgcagcctcggaccggtacggtcgtaccgcgccgaggtggacctgctccggcggcgcggcgggttctcgctggccgacgcggcctgcgcactgctcgcggtcggcgccctcaccgacgacgacgtcgcagcgcttctgccgcatctgccggcgtcctgcggcatcggccgccagcgggtgctcaatcggctcgccgacgacgacctcggtgcggcccgggcggctgccgaccggatccggggcgacaccggctggaagggccaccgggacatcgccgccgtgctggccgaccggggcgacgccgccgagtttctcgccgggtggaagagctaccgggcggcgacggaccggcacggcatgggtgagctcaaacgccgtctggtcgagggcgtcgcgcgcaccgcgggctgggcggcggcgctcgaactcgtcggcgacaagcggttcgggccggcgctcgcggtgcacgcgttcaccgcgttcggcgccgacgtcgacggcctgcgccgggtcctgggccgcaccggcgtgctggcggagctggaccagctcgcggtgctcagctcggcggtgctgcgggccagcggtaccgacccggtacgcaaccacccgtacctcgacgaactggtcgaccggatcatcgctgtcgacccgtccgccgaccgcgccaccatgcgcacccgcgaccggctgctgttctcgctgtggccggcgatgggtgagacggcgaccctcgaccgggtccgcagggcggtccggacaccgcaataccggcgggaactgacccggcttccccgcgacctgaccgcttcgctccggcactgaccggacacgccgccgcgtcaggccggcgcgtcaggccggcgcgtcaggccggcgcgtcaggccgacggttcagcgccagcgggtcgagcagcgccccggccaccgtgtcgacgtaccagcgccggaagtcctcgaccggccagccccgccggcggaccagccagtcgtagttgtgcacgtccatcgcgagccacagcacgtcggcggcggtctcgggggtgtgcccgggccgcagttcgccggtggcggccagggcggtggcgaacatcagcatgccggcacgccggtcggcgaggtgtttgcgccagatcgtggcggcgtccgggtcggcggtggcggcggcggccagggcgagcatcacctgggcctggcgggcgtggacgtcggtgaggtgccgggcgtagcgctccagtcgcgcccgggcgccgggcagtgcgcggatctcggcgacgaacggccggtcgggcagcgccaccggttcgtcgtcgccggcgacggtgacgtcgaccagggcggacagcagcgccggtttgctgcggaaggtcttgtacagcgtctgcaccgcgacgccggcctcggcggcgaccgcggtcagcggggtggccgcgtatccggggtcgacgaacagccgggcggccgccgcgaggatcgccgctcgggtctgccgggcctgctcctgacggtgatccgacgcgtatcgccgcttgacagccaccgcctcactgtagtgctctattcgatagagcttgactctactcaaaagaagagagggtacgccgtgatcctcgttcctcccccgctgtactacgcggccggcctggccgcgggcatggcgatcgaccatgtcgtcacgctgccgatcggggcccggccggccaccgcgatcgccggagcgctgatcaccgcggccggcgccgtgctggccgcggccggcgtcgtggccgtgatccggcaccgcaccacgatcgtgccgcaccacgccgcccgtacgctgatcaccgccgggccgtaccggctgtcgcgcaatccgatgtacaccgggctggccgtcgtctatcccggcctcaccctgctgctcggatcctggtggccgctggcgctctggccgctggcggtcctcgcggtgcgatggctggtgatccgctacgaggaggacgatctcaccggactgttcggcgagaagtacctcgactaccggtcccgggtacgtcgttggctgtgaccgccgcgcggtcgtcgagttcgtcgttccaggcccggcgcagcaccgtcggcacgtcgccggacagggcctcccggatgagtcccagctccgcatcggtcagcgggatcgccgggaacgcccggccgaccgccgtcgcgaacgccggcccgcgcccggccagcgccggggccgccgcgacgtagcgggcgacgtacggtgtgaccagctcccgccgcggcgacgtccacaggcccgcggcgagcgccaggaaacgacgtaccgaaatgtccggatcctgggtcatcgccgcccaggcgtccgctttcgccgcggcgtccggccgggcggcgagggcggtcagcgcccccagctcgccggccgcggtgccgtcgtgccgccgctcccgctcgatctgcgtcgcgtcccacacgccgagctcggccagccgggtaacgaccgtccagcgcaggtcggggtcgagtgccagaccgcggtcggtgctgcccgtggtcagccagcgccgcagcatgccggggtcggcggcggaccaggccagcccgcgggtcagcgccacctcccgctgcgggtcgaggtcaccggccggggtgcacgcggcggcgatcacgtcgagggcgcccggctggtcgcggcggcgcaggagctgccgggtgtggtccagagcggcggagatcagggtggccgacggctcgtgcggcaggtgccgggccagcaggtccaggtgggcggcgggggtggcgccgtcgagcagggcggcccacagtaccgcccgggcgagcgggtcgggcaggccggtgaggcctcgggtgatcacggcgtacgacagctcgtcgaagtcgaccttggcaaaggtctcgccgtgagcgttgggcacgacggccagaccggcgaagtcgggcagcgccagcggggtgtcggcgaggtcgacgaggcgggcgccggccggctgcagcgacgacgtgtacgcggtgaccgtgaaccggtgcggccgcaccccgtcgcgggtcagcaccggcacgtcgccgtcccgggtcacccggatcgtgtcgtggccggagcgccgcagccacccgtcggcccaggcgcgcacgtcgcgtggagaggcggcgtcgagggcggtcagcaggtcgtcgagggtggcgttgccgaaccggtgggcgctcaggtgcgcgttgacgccggccaggaaggcgtcccggccgagccaggtgaccagttgccggaggacggcgttgcccttgccgtacgagatctgatcgaagatggtcccgccggtggcggcgtccggcacctgctcggcgcgcggcgccaccgggtgggtggagcggcgccggtcggcgaggtaggcgcccggcttgaacgccgactcgaaggccacccgcgcacccggatgcccggcgacgttctcggccacctcgaaacccatgtagtcggcgaacgactcgttgagccaggcgtcctcccaccagaccggggagaccaggttcgcgaaccacatgtgggacatctcgtgcgcgatcaccatcgcctgccggcgccggtcgtcgtcggtgacccgctggcggggcagcaggtactcgttcaccgtgacgcagcccggattctccatcgcgccccagttcagctcgggcacgaacacctggtcgtaggagtcgaacgggaacggctccacgaagatctcggcgaagtggtcgaagcacgcctcggtgatccggcgcagctcggcgacgtcccggtcgagctgcgcggcgagcgagcggcgcacgtgccagcccatcggcaccccgcgatgctcccagcggaccgagtgcaacggcccggccaccacgacgaactggtcgcacgggatcggcggggtggtcgcgaaccgccaccgcccctgcgcggaggcgaccggcagcccgttcgacagcaccgtccacgccgggtcggcggtcaccgccaccgtgatcggcgccttgagatcgagctggtcgaagcaggcgaacagccgctgcgtcacgtccaaccccaggtagccgccgagataccgctcgccgtcggccggatcggtgaacgcgtgcagccccgcgccgtcgctgacgtagcgcagccgggcgtccacgaccacctcgtgggtccccggggaaagatcttcaagccggatccgattgccgtcgtacgcggtgagcagcgccgccccgtccagcgtcaccgtgggcgccacggccccgtgcagctccaggaaggtcgaaccgccggtggtccggaaccgcaccgtcacccggctgccgaagtcgtccggcgaggtcaggtccagcgccaggtcgtaggagacatcggcgagcatggcggcccgggcgcgggcctcccccagggtcagcgacatccgcccaccctacgacggcgacgctcacgcctccggatcgagcaggtagccggcaccgcggatggtacggatgctgtcccgaccgaacgggcggtcgaccttgtcgcgcagatagcggacgtagacgtcgaccacgttggagccaccgtcgtacgcgaaatcccagacgtgctcgatgagatgggtgcggctcagcgtctcccccgcccgccgcatcagctcgtgcagcagggcgaactccttcgccgacagcgggatccggttctcgccgcggcgcaccgtccgcccggccggatccagctccaggtcgccgacgcgcagcacggccggacgctgggccggctcgcggcgcagcagggcgcggacccgggccatcagctcgtccagcgcgaacggcttggtcagatagtcgtcggcgcccgcgtcgagaccccggaccttgtccccggtgccgtcccgggcggtcagcatcagcaccggcacccagcggtcccgggcccggatctgccggcacacctcgatcccgtccggctccgggatcatcacgtccaggaccgccgcgtcgaagtcggtctcggtgatcgcccacaccgcgtcggtcccggtggcgacggcgtcgacggcgtagccggcccgctcgaacgcccgttggagcatggcggccatcgccgggtcgtcctcggcgatcaagatccgcatcggtccagcatatggcgtcgcatcaaccggcccaacgagccgtgtgcgaggatcgtgacgaccggggaggtgccgtggtgcgattcgtgccctcatcgctgcgcacccgcctcgccctggtgttcggcatcggcacgtccctggtgctgctgatcgccctctccctgctctacgtcgtcctggaccgtcagctcgacggcgccgtcgacgccgacctggccggccggggcgacgacctgatcgccggcatccgctccggtgacctgaccacggtcagcggcgacccgatggcccagctgtacgccccggacggcaccctgatcgcctccggcgccgccctgtccggccaggtgctgctgctccccgaccaggtccgcagcgcccgcaaccacaccgtgaagagcgtcgccctgctcgacctgcgccccgacgagccggccctgcgggtccggctgatggcccgccccaccggccgcgacggcgacatcctcgccgtcgcccagcccctggccaccgtcgagagcgccggcaaccggcagctgatcgtcctggccgtcgccaccccggtgctgatcggcgcgctcgccgtcctcggctggctgctcgtccgcgccgccctgcgcccggtcgacctgctcacccgggaagccgccgcgatctccaccttcgacaccgaccgccggctgccggtgatcaccggcgacgacgagatcggccggctcgccgccaccctgggcggcatgctgtcccggctgtccgtcgccttcacccgcgagcgcgccttcgtcgacgacgccagccacgagctgcgcaccccgatcgcggtgctgcgcggcgaactcgacctggccctggccgccgtcgacgacccggccgaggtccgccgctccctgctcgccgcccagaaccaggtcgcccgcctcacccgcctggccgaggacatgctgctgctcgcccgcgaacgcgccggcgccctcgccgtgcaccgcgaaccggtcgacctgaccgacctggcccacaccgagcagcgcgccctggccacggtgtccggcctgcgcatcgaggtccgcggcgacccggtcatcgtcgacgccgacccgggccgcgtccgccagatcctcgccaacctggccgccaacagcggcgccgcgggcgccacgacggcccaggtcaccatcgtggccgaggaggccggcgcccggatccaatgggccgacgacggcccgggcttcccccacgagttgctcgaccgcgccttcgaacgcttcgtccgcggcgaccgctcccgcacctcggcgaccggcgccggcctggggttgtcgatcgtgcgggcggtgacgatcgcgcacggcggcaccgccgaggtccgcaacggccccccgctgggcggtgcggtggtcaccgtccacctcccgacgaagtgaccgcccctgccccggtcggcacttcgcatttcggcagagacttcgcttccggtgctgtcgccgcggcggtaccgggcggcagcctggacttgggcccggccgccgtcgacgtcggccgacgtggtgggccgcgacggtggcgaggaatggactcggtgtgatgcggggccgcgacgttgtagtgatcggcgcctccgcaggcggcgtcgaggcgctgggtgagcttgtgcggggcctgcccgccggattgccggtcggcgtgctcatcgtggtgcacaccccggccgactcggcgcgcaggctgcccgacgtcctgtcccggtacgggccgctgcccgccgcctacgccgtctgcgggcagcggctgacccccggcctgctgaccgtcgcaccgcccgggcagcacctcgtcctgaccgccggacaggtcctgcgtctgcaccgcggcccgctggtgcaccgcacccgccctgcgatcgacacgctgctgcacagcgcggcccgcgtctgtggtggccggacgatcgccgtcatcctgtccgggctgctccgcgacggcgccgacggtgcggccgcggtcgccgccgccggcggatccgtcctcgtgcaggacccgctggacgcccgccgccccggcatgcccaccgccgcgctccaccgggttccggacgcggcggtctggccggccgcgaagctgggccgggccatcaccgatctgctcgatgcagcccgcccgacaccgaccggtgccgtgctcgcaccgccggcgccgccggagcacggtgatccgagcggcatcgatgcggccctgtggaccgccgtgtcgcagctgcaagcgcacgccgccgcgcagcaggggttcctgcggcagctcgaccggaccggcccgctcgccctcgtggtgcgcaaacgcgccgcccgcacactgcacgccgcgcaggtgatcaccgaccacgtcatcccggtcttcgagccggaagccgggaggtgtgaagcccccggcagtgcgccgacctccccctgatccgggcggccggaagccggagtcaggaccgcagggtctggtgggggtgccggccgtgggcggcgcggtagtcggcggcgaaacggctgggccgcgcccacccccagcgggcggcgatggcggtgacggtgtcgacggccggatcggcggcgagcaggtcggcgtgggcgcgatccagccgcacccgccgcaggtaccgcaggggtgtggtgcccagatggcgccggaaagccagttgcagggctcgggtggtgacgaacgcggcccgggcgatgtcgaccacgctgaggtcgaggtcggggtgggactcgatgaacgcgaccgcccggcggaccgtggcggggtgcacgtcgtggcggtcctcgatggtcggctcgagcatcgcgttcgacgcgaacgtgtcgagggtcaccgacgccagcaaccgcgccgcctgcagcgcgaccaggggcgacgcatccggcccgggggttccggtcggatcgtcgtcggtcaggtggtggaggaacgcgaccgtacgcatgaaccgggcggctgcccgtggactcacggcgccatggccttcgagccggaccggcccggcaaccccgggcgcggtgcaggccacgtcggacagggtcgcgggatcgaagatcacgaaatcgctgtcgagatggtcgagggtggcggtgaacggctcgtcggcctccaccccgaggaagacgtcgcccggcccccacgtgcgtcgccgcccgcggctgacataggtggccgacccactgcggacatgcccgatgaccagtgccccgatgggctcaccggccatgtccacactcatgccgtacgcggcgtgccccagcgtgaccgggccggcggtgttctgttcgaccatgaaatgcttgttgtcgccgcgggtccgcagccggacggtcaggtactgggcgcggagcagctgctcgatgtcttcatgtccggtggcggacaggacccgcttcatcgtcgcgcctccccgggtctggcgcatgggtgccgcgccgaagacggggcgcggcacacgcatccggttcgcatgcccatcagcgtcgctcaccctaccggtcggcaggggggtacatggcggcgatgaattgcttgtcgccgtccgacaggtcggtgttccagccgatctcatagccgccgagggtcagcgaccggggcaccgcgtattgcatgatcgattcaggatcatggtcggtgaaggaaatcgtcccgtcgttcgcgtaccggtgcagcacgttcgcctccgtcttggccgcactccagccgtgcacgccgaggtagtacttgtagacggccggaacgtcccacggaatgtccgccgccgggctcgcctgctcgtgaacgcagccgatggcatggccgaactcatgcagcaccacagctcgcaactcctgcggatcatcgtcggcgctgaggccgcccaactgaatggtgggctttgcggacggcacggcgagagcctcggtaccgacgaatgaccagtagcccgatccggtgaacgtcacgcgcaactcggcgccggcccggtcggcgaaggtgaagcgcagattggcgtgctcaagccaggcgcgcgcgatctcttcgacccgcgccctggtccgcgcgtcgccgtccatgaaccggacaaccagttcctgcccggtctgccaacgtcggctgtcggcgaaggcgagctctttgccgctgaccgcgtcagccgccggtgcggcacggaaggccacgagatcgcgcggtgagtactcggtgaggcacagatggtcgatcgtcatcgttcactcctggactcacggttgtcgtggaggacccgctccaattgctggaggatcggcgcgatcagcaggccctggttccgccatacggtcatcacctcgccgtcgatctccaccggctgctcgacatcgcacagatggatcgcgacgacgttcgcgccctcgtcgcagaccggggaaccggacgaacccggcacggtgtcaacgacgtactgcaggtgctcgtcactcacggaggtaacggcctggtgctcgaacgcgaggcgtttcaggccacctcgcgggtgctgaatgatgaccagcggatttccggggagtacggggaaccggctacccactgtcaaaggaacccggccggtcggccgctccacccgcagcaccgcccagtcggcctccgcgtcgccggcaaccggggcggtctcggcccgcagcactagctgtgacccgcgcggggtttcgtcgtagtcgaagttgacggtgatcgccgtcgccggtcccagaccgtcatgacagaggttgtggtaggcggtgagcagcaggcgatcatcgatcaggaaacccgtgccggaagcctcctccgttccgaatgagacggtgagcaacgcgacactgccgacccgttcagcaagctcggaagccagctcggtgcggacaaaacgggcgcggccccgcagcagacgctgccgctggatcgcggccagctcggtggtcgcgatccgccaccgcggtacggatccgccgtccggcgacccgcctggcccggcatccaacaacttccggaattggtcatggtaggcggcgaccgccgggtcttgagcggcgtgttcgacgaaaccgcggcagatcccctggcgaatcagggcttcgatcaactcgaagcaggtcgaggcgagatctccgccccggggaaaaataccgtgcgccagtccggccagtttggccagacgcctcagctgtctccgccggtcgtaggcggccaacagaaggtcacgcaactgcagaagctcgggcttgcgccagtccggcgtggtgtcgtcgagtgggttcatccgccaccacttctcgggtggatcgcgtggcttgctcggggcggccatcgtaaccttgtcgtgccgcaccatccggacgcaatcccggaaggagacaaccgatctcgtgagcgcgaccgatcctcctgaaccgctgtctccgtggtgagcgcgagctgggacgggcagagacggcagcggctcctcgagcttctcctgggcggttatgaaaccaagagaccgttgcggcacctcgccaagcaggccgggctgaagaacggactctttccggacggcggcgatctccggtccgtctgtcatgacctgatcgagcgactcgcgaacgcgaagatcctggacgacttcgtacgctgtgcggcaaatgacgtccggctcagcggctcgcgggaagccctgctcgatctgctcttccctgaggtgcccgagcagaagccacccgatcgggtgctcaccgacaacgaacgcgcccgcttgaccgatctgatcgatcagtgggacaaggcgtcccgcctgcccgacgagtccgacgtggcggttctggtctggaccgcgctggggcacatcggccgggtcgagctgcgcgcgtgtcgcagcgtaccgatgatgatctcgctgctggatcagcgcatgcacgccctgggagccatgccggcgatcctgctgttcctggagcatctgctcgcccatcccgacatcgccgttagtgaggaacgccccatcctgcggcgactgatcgacgacgtggcacagcggacgcgggtggcgccggagaaccgggggccgacagctgcggccggtgagatcctcggccaggtcatggtctatctcgaactgctcgacgaggatggtcacctccggccggaggcactggtctaccggcagaccggcaaatcgtatttcgtctatcagtgtgtcgatgctttcccggattggcaggaggccgccgaacaggcgatcaccgagatcgcgccgctgctgcgccggttcgacccgggccagatccggttcgagatcgtcgtgccgtggcggctgctcggggagccgatggacgaatgcctgttcgccggcgcggaactcggttcccagttcgaggtgaccatcaggctgggcgagcgccggatcttcgcgctgtacgagcgtaggtgggagcgtcgtagccggctcctgcacgaccgcggggacaccccggctgaacatcttgtgcgggtggtgacgccggacgcccggccgggcacggtgctgcggcccggacggcccaccgacgaatcggtcgcggtcatgatcttctcggctgtccaccatccgcctcgcacgctgcccacgcgacacgtcctgctggatgcgttccgggaaggtgttcccgtgttcctgtggtttcgcggcgaccaagatcccagccagctccacgatctcgtcaagtccatgttgagcggcgcggaactgaatgggataccggcggcggtgcgcgcaaggcggcatccgtcggaaccggacgacagcgacggggctgccgcaggacagcccatctccgtgatctacgacgacttcggaacccgcccccgacggggcggatcgctgcaacccgcccgagcacgcggaggcacgcaatgaccaccacacccctctggatctatcggggcgacggcaacccacacgcctgggatgtccccccatcgccgccttggcgcgagttcgcgggccagccgatggatcgacccccgtcgccggacgcacccggttcccggcgacgtcggcacctggcttccacctatcgtgctgaaccgggcgaggcactcatggtgaacaccgccattcacctgcgccgtccgctgctggtcaccgggacacccgggtgcggcaaatccacgctcgccctgagcgtcgcctacgagctgggactcggcgagctgctctactggccgatcaccagccggaccacggtccaggacggtttgtatcgctatgacgcggtaggccggctgcacgccgccggcctgcgagaacgcacccgaggtcggggtggtgccgggacgcagatcggcaaatatctgagtctcggcccgctgggaaccgccctgctccccgccgaccggccgcgggtcctgctgatcgacgagttcgacaagggtgacatcgatctggccaacgatctgctgacggtgttcgaggagggccgcttcaccgtccccgaactgcagcgcctcccgaaccggaccgtcacggtccaggacgacgacggcttgccggtggagatcgaacgcggtgcggtggagtgcgcacagttccccatcgtcgtgatcaccagtaacggggaacgcgaattcccgccggccttcctacgccggtgcattcccctgcggatcgcgccgccgtcgcccgacaagctgcggcgcatcgtgcaggcgcacctcggccgtgaggtgctcgccgacccgctggtgcgggaactggtcaccgacttcgccgagatcctggagaagcaggacggaacgtacgccaccgatcaactgcttaacctgttgagcctgcgcaccggcgtcagcaagaccgacgacgactggtccgccctcacccggaatctgctcggccgactcgacgaccagccgtgatgtctgtccatgacgagctcgacgtccaccatctgctggacgtcctctggatggcacggctggtacgtgccgacgagaccggcatcgccggcccggtgggtgagacggccgacgcaagcgcacacacggcgacggacgcccgcccgaagggccccggctcgcccgtcgaggcgctctccggcgtggccgccgcggacgccctgcatcaaccggtcaccgcggccaggctggggtccggctcggctgccggcggtcgggccaccgcggaacatgctcatcgagcgggaagagccgggcaacacggtgacgcgacgccagtgaccagccgagcactacgtccgctgcgccggcgggtcccccgccgggaccgcatcgccctggacgaggaacggactctgcgcgtctctgcagacctcggtcgcccggtcgtgatcacccgaccgcacaccgaacggtggctggacctcgctctggtcatcgacgcctcgccgaccatgggcatctggcaggagaaggtggccgggctccggaccgcggttcgccgctccggcgtgttccgcgacgtgcgggtgctacgcctggtcaccgacgacgtgggagacctggccctgctcaccaccggcgggcaacgtcaccagcccagtgaactgctggaccgcaccgggcgtcgattgatcgccctggtcaccgacggggtcgatgatcgctggcacaccatcgaggcggctgcgatgctggcacggtggtcggcgcacaatccggtcctgacccttcaggttcttccgccggcgctctggcaccgcacggcgctcccgccgctacctctgcgcccccggcaggtacgtcccggcatctggcagtccacgtcgccatatccggcggaatacgagacctcgaactggataccggtagccgccgtcgacgactcgtcgatacatcggtgggcatcgacggtagtctcgtcccggccgcccacactcgagctgcccgcgataccggtcggcttcctgccgctggccgatcccgccggccccgcgatggccgacgatccggtcgaactcgtggcgctcttccacagcgactcttcgccgaccgccttcgcgctcgcggggtacctggcatcggcgccgatcacactgcccgtcgcccgggccattcaggaagacttgctgccggcctccgataccggccatctggccgaggtcctcttctccggcctcgtcgagcggatctcaccgcccaggcccgaagaggatcccgacgccgtggtttacgacttcctcccgggcgtccggcatgagctcttgcgcacccgccggcgcgacgagaccttccgtgtcctgcgtctactcggccgtcgctccgcatcggtcgccggccggctcggcaccgtggacctgttctcactcgccgagaacccaagcggctatctccgcgaccacccggacagccggctggcagcgaccgtcgcggtcaccgtgctcggcggcttcggtggcgtgtacgcggacaacgccacacggctccagctcatgctcgaagagaccgccgcgccggcgccggctctgacgaacccgcccgcgcttctcctcaaacccgcacccgacgcgacagcgggcacacaatgggccgctcccctggaattgttcggcagcggccccgtcgtcgccacggccagccaatgggcggaggtgcaccggttggccctcgccggccgcaaggcaacgatcgcccgcgacgtcggccatcgattggcgacggtatggttgcgtgtttcccggctcgcggacgtcgcggccctctcccgggccaccctgacgttggggcccgacgcgaacgcgctctacgacctgggccgggccgaatccggcatgggccggtaccgagacgccctggcgagctatgagctggcccttcacctgtaccgggatgccggcgcccgcggcgacgaggcggccgccctgaacaacatcgccttcctgtacaacaatctgggtgatgcggcacaagccctcgcctacagtgaacgggcactgtccatccagcgcgaggtcggcaaccgcgccggcgaggcggccgcgctgaacaacatcggctctgtcctctacaccctcggcgaccgacgacaggcgctcgaccgcttccagcaagccctggtcatccgcctcgaggtcggcgaccgtgggggcgaggccaccacccgcagcaacatcggcaacgttcttctcgccctcggtgaccggcaacaggccctcgcccatcaccaacaagccctccccatccagcgggagatcggcgaccgtgccggcgaagccaccacgcttcacaacctgggctccctttatgacgacctgggcgaccgcggccaggccctcacctactaccggcaggccctgagcctctgtcaggagatcggggaccgcgccggcgaagccggcaccctcagcaacctcggcaacctctactacgccctcgacgaccggcaacaagccctcgcctgccatcaacgagcgctggccatccgacaggaactcggcgaccgggatgccgaggcgacgtcgcgattcaacctggccgttctgttgtcgcaaacggaacagatcgacgatgcagccgctcacctacgggaatccatcagactggccgaggagacgggtcatccgtcgctggagcggatccgctcgttcctcgacgaattgcagccatccggcgggaaacgtccgaagggcggtgggcagagccggtgagcaggatgacctcataccagttggagatcttcgaacagattccgggttcgtacgagctcagactggtcgcccctgacggagcggtgaaaacccgcagcgtccctcgggcggttgtcgacgacctcgtcgaaacagtggaccgctactacaccgagcatgcgatcgccccccgcgtattcggatcgacacagctgcaggacatcggcacaagattggcggggttcatcgacggtgacaacggttggctgacgccgttactgagcccccctggcaccaccgtacgcatcgtcgccgggcaacgcctccggcatctgccctgggagctgcttttcgacaacggctcgttccctgccgtcgatgaccgtgccgcactgctgacggtccggacacgcggcacccgccaggtccatacggattctcccctgcccagcaaccgtccgctacgcgtgctgttcatggccacttcgcccgagggggtggaaccggtcctgaattacgaggcggaagaggctgccatcctggccgcaaccgcgcgcacaggcaccgcactggtcgtcgaagaaagcggcactctggagggtctgcgctttctcttccgggattacggcgccggatacttcgatgtcctgcatctcagcggacatgcgacggtcggcgccgacggcgagccggtcctcctactggaaaacgagttcggcgggctgcatctggccaccgcggaccagctggtccaggccatggccgggcattggccgcgtctggtcttcgtcagcgcctgcctctccgccagcgcctccacggacgacgcaccgctctccctcggggagcggctcgtcgacgctggcgctcccgcagtactgggttgggcgctgccggtcggggacagtgctgcgatcgagttcgcggccgaactgtaccggaacctggctgacgggcagcccatcgacgcggcggtcgtggcggcccggcggcacctgcaccggcagaagagtcccgcctggcacctcctgcgggtctatgccgacgacacaccgctcgacgcgatggtgacaccgttgcacaccacgggccgtgcacagcttcgtatccgacatgctgatcagcagtttctcgatccgcgcaccatggtgtccagggttgccgctcgcaaccggttcgtcggccgtcgtcgagtcattcaacggtgcctacgaaccctcagacggcccgacagccaggctctcgtcctgcacgggatgggcgggctcggtaagagcagcctcgcctcccgcctgctggaacggatgccgacacaccagcacgcggtctggtacggccgagtcgacatgagcaagttccgggagctcaccgacaaggtcgctttcccgacgctgacgaaacacatcgaggcgatgacgttgctgagccaggatgtcgttcccctgtccgttcgcctgcgctacctgctggatgcgaacggccccctcggagacctgccatgcctcttcgtcttcgacgacttcgaggacggcaatctcgagcaacaggacaacggtccggtgctgtccgcggcgatggcggaaatcctgcctgccctgctcggcgccatccgtgacaccggcagcaccagccgggtcatcatcaccagccgctaccgattccccgcaccgaccggaagcggattgacggtggagtcactcgagagtctcaccgacgtcgagcaggtgaaaaagctcgccaacctgcccaacttacgccccggctcacctctcgaccagcgcattcgcgtccgcgcgattcaagccgcagccggcaacccccgcctgctggattggctcgacctgatcgtggccgacgccactaccgagccggacgagctcctcaccgcgatcgaggcgacggcggaccgattccgcgaggagatcctcgccgagaagctcctcggctctcagccacccgagctgcggagaatgctcgccaaggtcaacgtcgtcgaactgccggtaccagcgtcgacggtgacagcgatgcacgaccacccgtccgctgaccgtcacatcgaacgggccgtccaactcgggttgctggaagaaggcgtcgaccacgacacccgccgcccccggtaccacgtctccaacgtgctgcgcccactgatccgcccgctgctcaccgacgacgaatacgtcgaagcctgcgctgcggcggctcagtcgctctaccacctctgggtcgtcgagccgaccaaccgcgagtactgaccatggagccagtgagctgagtcacctgtagcgatggagccctggctggacatgtacaggccggacgcggatcacaccgcccggaccaccaggagcagccgatgacgaccgccactctcgaccgaacggccgtgcgaggtgactccgcccccgggccgaaaggccggcctcggctgtacgtgctggacgcgatgcggctggtgtgcgcgctggccgtggccggctaccacttcggggactcctggtgggcggacggcacgcatcgacccgcgtacttcctgccgcacgcggcgccggtactgatctacggcttcctgggcgtcgaggtgttcttcctgatcagcgggttcgtcatcctgatgagcggctggggacgcacggtccgggcgttcgcggcctcccgcgccgcccggctctacccggcgctctgggcgggcgtactgatcaccgccctggtcagcacgctcctgccgatcgagggcgggctgccactcgggccgctgccggccggccgggacgtgctggtcaacctgacgatgctggcggagccgttgaaccggccgctggtcgacaccgtgtactggacgctctggtgcgagttccggttctacctgatcgtcgcctgcatgctcgccgccgggctcaccgcgaagcgggtgcggctgctcggcgccgggtggctgaccgccgcgatgctcatgccggccttccccggggcggtgctcaaccaggtcgtgatggccgacttcgcgccctacttcgtcgccggaatgaccatgttcctgctgcgccgcgaccgtcgcgactggtgggcctggctgctgctggccgtctgctggctggtcagcctgcaccacgtgcagctgcgggtggcggacctgcgtcccggcttcgacgtcgcggcctggccggcgccggtgctgctcaccatggcgtacggtgtcctgctcgtcatcgccctcggcggcacggaccggatcacctggcgatggctgggcacggccggcgcgctcacctacccgttctacctggtgcatcagcgcgtcggctacagcctcatccgtaccgcccgcaccgcgaccgggctgcccgtaccgacactgatcgtgggagccgtcctggtcctgctcaccacggcatggctcatccaccgcctgaccgagcggccgctcgcaccgtacgtccgcgctctcctggcgggtccgcgcagcctgccgggcccggggagagtggggcacgacactgatccgcgggatgacacacgccggaaatccgggcttaccacaatgtgagacatgaagtcgccgccgcagctagccgtcaccgtcgccatcacccgacggatcgacccgtcccgggatgcggagatggccgcgtgggtgcgggccggcgcctcgctggccgagaccttcccggggttcctcggcaccggttgggtccgccccgagccgcgctccccggagtggcacatgctctaccgcttcgccgacgccggctcgctcagcgactgggaggagtcgccgcagcggcagtggtggctctcctcggccgagggtttcgtcgagcacacccgggtggagaagcgcaccgggatcgaaggctggttcgacccgccccgggagtccccgatcgacccaccggcgccggccgctccggcccggtggaagcaggcgaccaccatctggctgggcttcttcccggtcagcctgctctccggctggttgctggccccgcacctgatcaccctgaacctggtgctgcgcacgctgatcagcacgctggtgctgaccccgatcatgacctacctcgtgctcccccggatcaccagaatcctgcagccctggctgcgtcgcggctagccggtcacggcggcggcgggaggtctcactgccaccgcgcccggcggctccccggctccgtcggtcggttcgaggtcctggcacagcaggtacggagctccgccgcgttcgcgtgcggttccagtgggcggcaggtgtggtggcgaaaccgacggcgccggctgtagcgccgcgccggggacgggagacgggcggtggtcgagaaagtgatcggtcgccgggcttcccgggcagaaccgcggctcagccctcgagcaggtctcgcaacgccgccgcggccagcgtatctccgccctccgcggcctgacggaagtgccattcggcaccgaccaggtcgccccggcgttcgagcaggttcgcgaggttgtggtgggcgtgcgtatcaccgagctccgcgccggcacggtaggccgcttcggcggcgtcgtcgtcgccgaggacatcggcgtagacgttgcccagcgggaccatgctctcggtttcgcccagctccatgccccgcagaagcacgaggcgcccctcctccacccggccggtgttcaccagcagggcgccgaggtcggcgcgggccgaggggtaaagctcggccgcggcgcgcagggccggctcgagggaggggtcgaggctctggtcccaccgccagcaggccagtaccgccgcggcgaatgtgttcccggctgcctcggcgcgttccatcgcgacgaaggccgcggcacgctcaccctgctcccgcagggaaaaggccagcgcaaccgcgccgccgctgtcgccggcccgctcggcctgttcgtacgcgcgcatcgcgccggccaggtcgccgagaccgtccagcaccacgccgaggttcagccacgcatcggtctcaccaccagagagggcgagctcgtaggcgtcgaccgcctcatgaaggcgcccctgatctctcagggtgttgccgaggttgaacgcgccggcgggttcgccgagctccgacgctcggcggaagcagtactcggcgccggcggcatcgccgctgtccgcgaggtcgcacccgatgtcgagcagatcgtcgacatcggcggtcgcgtgcgccctacgcagcagctcagctgaggtcgtctccacgatctcgatggtgcctcacggggcagccaccggcttgcccggtctcggcagatcacctcgggagactcgcaccgaccgaccggcgggtccgggaccgctctgaccggccgcagcaggctgtcgcgaccgtccggactccgaccctggtggcgagccggacacctttcacgacccgccacccgaaggacaagaagaggggctgggcgtccgtttggcgggaagtggattgacgagcgtgacgtgtcgacacagaatcaggttcgtgagagcgctctccggcctggccacaccacctgcagtctcacggagagctcttctgctccgccgtaaggagacccgcatatgcggatagatccagccgcggccgaaggtccgccgcctcgcatcggccgggccacgcggaccgccggatcctggcagccgtcagcggcgcggtcatcctgtcgattctgaggggatacctggcccggtgccggccgcgccgagcaacccggcggcgaccaccccgaggtgggcatcgcggcgattccgctcgagagcggcccggcgggcagcacggcgctgcggcgaggcccggctgacgttgcaggaccgggttccgaggttcagttcacccgggcagcgtgtcctgcccaccacggtgactccatctggggaaaccgatcaacccggatgtctcctcggtgatattggaggtcaacatgttgcacggtgcgcgttcgcccggcggtaggcggcttctctatgccgttgtgacgcttgcggtggcaggtgctgtcgctggagtttcgtcggtcgccgacgccgcagtggtgacgggtctccactatgtggccatcggcagttccttcgcggcggggccgggcatctcgccggtgcagtccagcaccggggccgcagcctgcgctcggtcgagcaacaactatgccagcgtggtggcccgcgacctgggagctgacctcaccgacgtctcctgtagtggcgcaaccacggcgaacgtgctgaccacaagccagaacggcctgccgccgcagattcaagcggtgacgagcgccaccgacgtcgtcacgatcaccgtcggcgggaacgacgtcgactacctcggcagcatgggggcgtacacctgccagaacgatggcggctccacctgcgcgagcgtggaccgtgcggcgatcgacaaggcgttcgctgatgagcccgcacgcctgcagaacgtcgtgaacgcggtacacagcgccgcgccccaggcacaggtttacctggtcaactacttcacgatcctgccggactccggcacctgctccggcgtgccgctcaccgccgaccaggtggcgtacgaacgcagtatcgccacccgcctcgcggcagccaccgccaccgccgcgtcagccgcgggagcgacgctcgtcgacgtggccgcagccagccacgggcacgacgcctgcgcagccgatccctgggtcgagaacggccacccgccgaccggacgcacccagtaccacccgaatgccaccggaatgaggaacgccgcccaggtcatcgaagcggcgttggccgcccgcggtcaggttcgcgccgccgagttccgctccggtatcgcgggtaaatgcgtggacgtcgcgggcgcgggaactgccgacggcaccccggttcagctgtacacatgcaacgggaccgtggcacagcggtggacgttcaccccgggcgccggcggcagcctgcgcgtcctgggcaagtgcctggacatcagcaacggcggcaccgccaactccaccagagttcagttgtggacgtgcaacggaaccggcgcccagcgctggaccctcggtgccggctcgtcattggtgaacccgcagtcgggccgctgtctcgatgatcccggcggctcgacatccgacggaaaccagctgcagatctttgattgcaatgccaccgtcgcgcaacagtggactccgacgacctgatttcctggtccctccgtcatctctgcggctaccggttgttcgttgaatccgcggccgtatatgccttgtccgtgctgccggtttccggggccggtcagccttgcccgacctcggacgggtggcgggagctcgttggatcgtggaggaagtcataggccaatcggtcggcattttctcagctcaccggctcctgaatgacatcgcgacagccctgggcccattgatgcccgaccgaattaccgataaggaatgtgagcctcgtccctctgtcacacgggcgtcatttctgccgtctacgttgaaatggaagctccgatgcccatcggcagcgcccaccgttttcacctccctgaaggacggtttgcatgttccgcatcatcgccgcatcagctgcaaccaccgccgctgtcgccctgtgggccgctcccgctcaggccgacgcccctctgatcgagaccggcgtgaccgccgtctgcaatgctgcgaccggcaactgggacctcacctggacgctgacgaacaacctcaacagcccggcgctgaccatcacgcagatctccaccccggccccgggcgtcggaaccctgccgtccgtgccggggaacggcacggcgcaggcgcatcagaccgttgacggggcagcgtcgagtgcccaactggactacgtcgccgtctggacccaggtgtggccctcggtcagccggtacagctccacgacctggaccgctcctaccgcgaacggcgacgtcacgatttgcaccaagacggcctgacgagacaccgggacggcggtgcgcgggcgaccggaggcctccgcaccgccgtcccgtacggcatacccacaccggcacatcgccccaccgtggcagaaccgatgcggtggtctgcttcatgagcgcgacgggctgccgctcacgtggaggcgaagtgccaacgatcgaaaagcgaccatgaagacgcttggacgtcaagtgccgcgataccaccacagaggtcaaccggacacgatcgagaaaccaatcggaagcccgaagacgcgtcaagcttcctgatcgaccttccgggcagcggatagctgcggcgatcatgattgaccgcccgctttcgtcaccaagactcaaacgcccggctagaggatcagatcgatcgcccgctgattcataccgacgaggacgcaacgcgacgagctggcctctacgtgcgaggatgcctactgaccgaagccaggtcaacgcggtgttcgcacggttctgtgtcgcggaggctgaagggagccggacatgctggaagcgctgggccttgtcgtcgatttcctgacgcgggccatccctgcggcggccggacggcggcggaagaagaaattggacgatgtcggctctgaacttttcctcatctattttcgactgaacgaagtcattgtcacggcggaacgcattctcggcgtgttggagaactacgttcgccggatgagtcagaatgacggccgcagtcacctgctcgaggatctcaccggaaagagctggcagaccggtctcctcatgcgacaacgcacaaacctgcaagaggtggccgagctgattttccgagacaggagcggtctcatgcttatcgatgctccgtcgtacaatgcactgacaccactgctggaccgaaaaatgggattgatccgggtcctcatccgcgcaatggacggaaacaggctgccggtggcgccgtccgcggaggacatccattgtgtagtatccctttatgctctcggaggacagcaccttgatcttgactcggaagagatgagaagggtccaggacagaatattcgccgaagcgctttccttcgacgatgtcatggatgagagcacctaccgggcggttcagcgctacctcgacgccgagaatccgcgagagcaactcaaacggatcaagggatccgtcagtaacatgagacggtctctccttaaacattttaccgttgaagacatgttgctacgcgccggagacgagcgtttctcaaattgatagacagggctatgatgcatcgtccgacaaggcaccagcgggaaaggttggcagccgcggtcggcgacccggtgccggtcctctctccggcgtaggtcagggtgagcggggtgacggcccgctcccttctggtggccggattctggccgcctcaatcacttcatcagccttgatgcctcataccggttgactcatggcatatccgcgcatcgggtggtggtgagttcgccccgcttctggccgtcggcggattgcgcctccgctcggacgcaggcgtcagtgaccgaaagcatgttggagaagccgatggtcccgccgttgagtcgtaatggatatgaggcgtggcctgagatgcactcgccacgttgcgcgacagccatccggccccacagcaacgcggcgggccggcccgccgcggataccgggaagtcatcctgacgtcccaccgtcaggacgacccgatcagtgcgccctgcgaagtgggacggtggttgcgtccagcgcgccctgatccagcccgctctgcagccgcgggagtaccagagttcggccatgccctggtcggggtcgccgatcggcgcggaggccagcttgaccaggcccgcggtgacgcagcgagacacctccgggtcgtcggttgcgcatccctggtcctgctcgacacaggtcggcgtgctcagcagcggcgtggcggcgcacgagctgatggctggagtgcccgggtcggtatcggtgtgtccgtcgaacacccaggtgccgtcgctcagccgcacccatcgggctgtggtgctctcgatccagtgcggatcggggttgtcagacgtggcgcccgacaggacgcgggtcgttccggcttcgccggcgccccggcagttgatgtccagctgagtgccgttggccaggaaggtcgtcgtcgggctggcgaaacgcggctcggtgtgagcgtaggtgccgggcttgtccggcgcgacgacctggtagatgtcatacgggcggtcccaggcggcggcaggttctgccgtgcagagcggcaccgtggacgcgctgagtgaccgtcacctgaaggcgtcggcgagggcagaatgtgggcgtgccccgacgcgatcgtggcggcgctcaaccctgaggtcagggtcgcggatctgcaccccgaccccgcgacgatcggctgtccggcgggaagtccttgacggccgcggcctgcccgcggtcgcgccgcaggtgggcctgctcccgcagcagatactgcaggcgggacatgccgcgccggcccggttcgtcgagtttcagcgctacggtctcggcctgcagccgggccgcgcggcgggccagccggtgcaggcggcgggccacgagccggtcgacgtgcagcgcgatccagccgcacaccacggcgagcggcaactccaccagggccgccgacagcaccgcggacagcatttcggcgcggctggacagggtcaggtcgaaccacgcgtcgaccaccagcaaggtcgccgtggccatcgcgaccaggccgacccgctgctggccgcgccacgccgtgtacgcggtggtgagcaggccgagcacgagcatcacgtcgaagccgacccaggcggtccggtagtagccggtgtccatccgctgcggcagggtgaccgacagatagatggtccacgggatggtggccgcccccagcagggcgaagaccggtgccacccagcccggcgcgggccggcggggcagaccgcgggtaccggggtcagtgttgctcatcggtcgagcatgccaccaccgacggtgatgcgctcgcggggagcgggcgtggcgacagtggtctcgaacgtcggcaggaacgcctcggcggtcagcgcggccaccgcgatccggggcaggtcccgggcgaccgggaagcacaggtagcggggctgccaggtgggcaggtacttggcgttggcccggtacagcgattcgatctgccagacccgggacaccgcgcgcagcagccggtgccacatccgcaggaccgggccggcgccgagctgttcggcgcgggcgaagacgctgcgcagcacggcgaagttcagcgacacccggcggacgccgaggccggggccggcttcgatggcggtgaccaccatcagttcggtgagtccgttcggcgcggtccggtcgccgcgcatcaggtcgagggacagcccgtcggcgccccagggcacgaactgcagcacgccgcgcagccggccgtccccgtcgcgggccagcacgagcaggcagtcgccgtcggccgggtcgccgagccgggacagcgccatcgagaagccgcgttccacgttgccgtcgcggaaccattcggcggcccggatcaccgcgtcgaggtcgtcgggcgccaggtcccgctggcggaccgcggtgcacgtgtacccggcgcggctcatccggttgaccgcctggcgcaccgcccgcatcgggcgtccgtccagcgagaacgcgtcgacctcgacgatcgcctcatcgcccagttcgatcacgtccagaccggctttgcggtacgccgtgccgccggcccgcccgcacccgaggaccgccggcgtccagccgtgcacctcgcagtcggccagccaggcgctgatcgcttccggccaggcggcggccaccccgatcgggtcgccggaggccaggctgacgccgcggaccacccggtaggcgacgcttgctttcccggacggcgcccagatcagcgccttgtcggcgcgcagcgcgaagtatcccagcgagtcgttgccgccgtaccgggccagcaggtcccgcagccgggcgtcgtcgtcgccggtgcggaccggtcgccgctcgccgggctgcaggaacagcacgaccgcggcgagcaccgcgagcagcccgaacgtgccggtggtcaggcacaccgtctcggccgcccagggccgcacgaagtgcaccggcccggacaccccgatcagcccgagtgcggactgctgggcccacgcctgcacgccgggcgtgccgaccaggtggtcggcgcggatcgcgatctcgatcaggccgagcacgaaaccggcgccggcgaatccggcgagcgcggtcagcgcgcgccaccggctgcgcggcccgggcacggtcttgaaattgccgcgtacggcgatcagcagcaccagcagggcagccgacaccgcggcagcgtcgaagtcgagccccttgaggatgtgcagcgcgatcccggcgcacgccacgaccacggcgagctgccaggcgcggcgtttgccccgccgcagcccggcgcccagatagatgagcagggcgccggcggccgcggtggcggcgcgcgccgacagtattccggcgaccggcacgaattcggcgagggccatgatccgcccgtggccggccggcagcagggccgccgcgacgttgaacccgccggcgacctggaccagtcgggcgacggcggcacgggacaggggcggccgggatttccaggggcttgcggacatcgtgtttccttcggtgtcacggggcgagccgaacctaggagccccttgatgagaggacggtgagaacccgaaaggggtctctcatagggctctcatgaaccgggcggcacgctgaccgcaccccccgacgagatgagaacgtatgtccctgaccggtgtgccactgctctgcctggtggccttcggtgcggtcgcggcgatggccggcagcgtcgtggtctggcggcgcggctggcggccgcgggtgccgctgcgcgccctcagcgtgctgctcaccgaaaccctggcgctgttgacggtaggtctggcggtcaaccgttcggaggaattctatccgtcctgggcagctcttttccccgctgccgagcaggagccggccacggtcgcggcccggcccggcgacctggacgcgtggttgcgcgcgcagggctcggccgattccgggcaggagatcagcgtcccgtggaagccgcgcggctggaccggctggcatctgtccgccgccccgaccgtggtcgtcccggccggctacctgcaacatccgacgaaccactattcggcggtcgtggtgaccggcacggggtggaccgtcacgcccggcgtcgcggagcagaccgtcgtggtgttcgtgccgaccaccgcggcgaccgggcccggtgtgctgaccgcgtcgctgcccgcgctgttgagccacgacctgcgggtgaccgcgcgccggtgggcgctggtcgccccggccgccggcgccgccctcgtcgagcaggcggccggcaccgccccggaccgctacccggcgatcgcgctggtgcgggcgaaggtcgcgccggtgctcaaggcgttcacccggctgctggtcgccgggcacggcgtggccgcgcccgtgcatccgtccaccccgccggtgccgcccggcatccggctgaccacggtcgacggtttcccggccgggatcgcctgggcgatccggcagaccccgccgccgctggacaccgccatcccggcgcccacctgggtgccgagccagccgccggtcccgcgccggtccccgggggcggcgccgaagccgaaaaccccggccggaccgccgcaggtctcgcccggcccgacgacaggagtgaacagtggctcctgacagcctcggcgctgaactcgtcgccctcgccgccgcggtgctcaccgccgtactgctgagcccgctctggaatgtggccggcggtcgctggcggttaccggtccggggtgccgcgctgaccgcctgcctgctgaccgcgaccgcggccggcctgatctgggtcaatcacgaggtcgacgtgtacccgacctggggcagcctggtcagttcggacccggcggaggcggccgcggccaccgggccgcatcccgcttccacgaagacgggcgccaccaccggccagatgctcaccaccacggtcgccggcaaggccagcggcctcaccatgccggtgtacgtctatctgccgcccgggtacggtcagcagcccgatgtccactatccggtgatcgaggcgctgcacggctatccgggttcgccggtgcagtgggtgcaccggatgaacgtgggcaagatcctggaccgggagatcacggccgggcggatgtcgcccacggtcgtgctgttcccgtaccagacgccgtcgccgaccatcgacaccgaatgcgccaacctggacggcggaccgcaggccgagacgttcctgacggtcgacctgccggccgaggtccgcgccgactaccacgtgcgcgccgaccccgccgggtggggcctgatcggctattcggccggcggctactgcgcgaccaacctgctgctgcgccacccggaccggtacgccgccggggccagcctgtccggtgacgccacccccggcatccacatcggcaagggcgccgagaacaccgtgtacaacgacctgtggcggctcacgcacctgcccatcccggccgtcgccctgtacctggcctgcgccaccaccgacaggatcccggtccgcgacatgcacgacctggcccgcgccgcccacgccccgctgtcggtcaccaccgcctacgtcggcgggggtggcggccacaacgtcggcacctgggaggccatggaagctccggcgttcgactggttgtcgacctcactgggccgtccggtcgtacccccgccgtcgggcgaaccgcaaccctccccggtcggcagcccggcgggcggacggtgaccaccgcgccggcagccgacgacgtctgccggcgcggcgaaatccctggccccgctggacggggccgggcggccggaccggcaaccgggccgtgatgatcaggatgggtagactcccggggcgcgaaagcggagggggagagatccggatgagcatgccgctgcgcccgggagatccggtccggctcggtcggtacgagctggtcgggcggctcggtgagggcggcatgggcacggtctacctgggccgcgacagcgacggtgggcgtcctgtcgcgatcaagatggtgcggtcggagttcgcgcacgacacggagttccgcggacgcttccgcagtgaggtgaaccgggcccggcaggtgccgtcgttctcgaccgccgaggtgctggacgccgatcccgatcatgagccgccgtacctggtggtggagtacgtcgacgggccgagcctggcggtcgaggtgcgcgagcgggggccgctgtccggggccgcgctgcagggtgtcgccgtcgggatcgccacggcgctgaccgcgatccacggggccgaggtgatccaccgggatctgaagccgggcaacgtgctgttggcccgcggcggcatcaaggtgatcgacttcgggatcgcgcgggcgttcgaggccaccagccggcacacccgcaccgatcagatgctcggcacggtgtcgtacatggcgccggaacgcttcgatccggccgatgcacggccggtcaccccggccgccgacatcttcgcctggggcaccgtggtggcgttcgcggcgaccggccggagcccgttcgccgccgattcggccgccgggacggcgatgcgcatcctcaccagcgagccggatctgaccggggtgccggagtcgctgcgcgccgcggtggaatggacgctggcgaaggacccgcaggctcggccgaccgcccgggaactgctggatctgctgctgggcggcgaggcgccccgtccggtgccggagatcgcgccggtcccggtcaaggcccggcgcgggcgtacggtcgccggggtcgccaccgtgctcgccgtgctcgccgcggccggcgccgggctgacgatccgcaaccggctgcaggacggctcggcgggcaccggcgcctcgtccgccggcagttccagctcccccgccaccgccgccgcgtcgaaccgcccggcgccgaaaccgtcggcccggtcgctgtcaccgctggagaaactgcaggccatccggaacggcagacacaagacgctgatccactccgtccagctcgaccgggatctggcgatggagtcgcacgacaccgagatccaggccggcgacggcaccgggcacaagtcggagttcgcgctgatcccggccggcgtcgacgtcctgatccagtcactggccgcgtcgacgcccgggcgtccggtgtgtctcggggtccggatcaccgcggagtcggcgaagctgaccccgtccgagtgcttcaccgggccgggcacccagttcgagctgatccccgccgagaagaaggaggaccagggccggccggcgtactacatctacaacgactccagcggttacctgctgtgggacggcaaggccttctacgtgcaggaggtcggcgacggcgacccgatctacacgttcagcttcgtcgaccgcggcccgctgcccagcccgtcggccacctgaccctcagccgagcagggtgtattccggtttgccgcgcgccggtggccgcatccggaacgccatgacgatgccgctgacgaacaacatcgggacgagcatccagagccggatgtcgtcttcccggccgtcctcggccagcaccacgacgagcagaaccgtcgcggacagcaggccgatcgcccagccggcgtagaaccggcgggagtgcgggcggggcatcggctcgtcggtgacggtcacgccggggttgcgcacggtccactgcgccgcgacctcggccgggaccttcggaatgcgcagatcaccggagggcagccggcggggccgctgcgccggcagccccgcggtcacccgctgccatccgacgatcgtgcccaggtacaccgcgaggccggccagcgagacggcgagcggcaggtcgtgccggtggagcgagatccagtagatgatcagggtaccgaacagggccggcggaccccacggcgcgagccggcggtgccgcatcgtggtcgcggcggtgcgcggatcgaggggcaggcgctgggacggatcgcgccggaaggtgttctggccgatcggcaccggcgcccagaccgggtcgggcgtggcgtcggtgacggccagcgacgggatgtccaggcccgccaccaggtcggccggaatgacgaggtcggttcgcggggtcatcgccggtagccgttcaccgcgcgagccagttgatcatcatgccggcagcgtaggccgcccggagggggaacggaatccggcatccgggccggaccgggccgtggctatggtgcgccgatgggcatttctccatatctggcccggctgcgggcgatgatcggccacgaactcatccagttgccgtcggtgtcggtcctggtcgtcgacgatcgggaccggatcctgctggtgcgccatgccggggacgccgacggctgggcggttcccggcggcgcggtcgacatcggcgagtcgccggccgccgcggcggtgcgggagatccgcgaggagaccggcatcgtgatcggcccaccgcgactgctcgaggtgctcggcggtgacgacttcgaggtgcgctatcccaacggggaccgggtcgcctacgtcaccgcggtctaccgggccgaggtcgccgccgggacgccggtcccggatcgggaggagatcagcgaggtgggctggttcgccgtgcgggagctcgatggcgtggacctcaaccggttcgcccgggcgctgttgctggccaccggccatctccggcggcggccctgaccgtggttccctttcgagggagacaggttgcgtcgaaatctgcgtcgtttctatggtggtggttcagcgccttgaggagcgtggtcacatgcctaccgccaccagggaacgcgtcttcccactgatcggtcccactcgcccgctgcgcgtcacccgccgcctccaccgggacgggctgcgcaggctcgaagcggacctggccgaacgcctccggcacgccacgggcggcgtcgtgaccgtcgacctggcgccggcccggtcgatcggtccggcggcgatcgccgcgttcctggaatggacctaccgtgcccggcagcggggcgtacggctggagctggtccgctgccggccggcggtcgccgcggcgctggagcggtgcggcctcacccgcgacctccctgcgacaccgcgagcaggacggcctgccgctccagcagccacggggtgagccggtccggggcctgcggccggctcaggtggtagccctgcaccaggtcgcagtcccagcgccgcagccgctcgaggaccgcctcgttctcgacgccctcggcgaccaggcgcatgccgaggttgtgggcgagctcgacggtgctcttcacgatcgccgcgctgcgcgggtcggtgtcgcagtgcccgacgaacgcacggtcgagcttcaggtcgtcgaccggcagcgcgtgcaggtaggccaggctggagtagccggtgccgtagtcgtcgacggccagccggatgcccatcgcgcgcagctggtcgagcgtctcggtggcacgggcggcgtcgcgcatcaggacctcttcggtcacttccagatgcagggcggccggcggtacgccgtatcgggccagcgccgcggcgacgtgcccgggcaggccggggtcgtgcaggttggaggcggacaggttgaccgccacggtcaggtcgaggccggcggcccgccagtcccggcactgctgcagcgccatctcgaggacctgggtggtgagccggccgatcagcccggcgttctcggcgagggccaggaagccgtcggggtagaccaggccgcgggtcgggtggtcccagcgcacgagcgcctcgaccccggacaccgcgccggacaccaggtccagctgcggctggtagtgcagcacgagttcgccgttgtccaggccggtgcgcagctcttcgagggtggtcagccggcgccggccggtgtcgtcgtcggccgcgccgctggcgatcgccaggccgctgtggtcgctcttggcggtgtacatggcggtgtcggcgtgccgcagcagggtggtgcggtcggtgccgtggtcggggaagacggcgagcccgatgctggcgtcgatgtgcagcgtgacctgttccagctcgaacgggtggcgcagcgcggtgagcagtccggtcgcgacctgcagcgcccgatccatgtcggcggccggcagcagcaggccgaactcgtcgccgccgaggcgggcgagcatgccgtccccgccgaacgcctcgccgagccgggcggcgaccagcagcagcagctgatcgccgaggtggtgcccgaagctgtcgttgatctccttgaaccggtccaggtcgatgatcgcgaccgccatcggccgctgcgggtcccgctggtgcaggtcgcggtccagggtctcctggaacagccgccggttgggcaactcggtcaggtcgtcggtgcgggcctgccggcgggcgtcggccagcgatgccacggcgtgcacggtcagcaccatccgcgccaccgccgccatgatcgcgatggcggcgaacgcgctgctggcgtgcggcaacacgtactcgtgccagctgccgtacagcaggagtcccatcgaggcacaggccagcaccgccggcagcaccacgcccacggtcgcccgggccggcgcccggcgctccggtcgctccgggtactgccaggcggccagcgccaccccggccagcgcgaccgcccacagggcgtcctcccagctgcccgggacgaacgagccgtgcgtggtgtcgaacgcgtgcagcccgttcgcggcggtgttcgtgcccattccggcgagcagcagcagccacacccgttcggtgcgccagccgctgagcgcccacacgccgagcagcaggccggagagtgcgatgtcggcgatcgggtaggcgaggctgaccatgaccgaggtggccggcccggtgagaccggtgaacccggttaggaacagcaccgaggcgaacgccgccgcgcaggccgcggcgatcagcccgtccagcagggtggacatgctgatccgggaccgctgcacccacagcagccgtaggacggccgcgtaggcgaacggatagtaggccagccacatcgcgtcggagaacgacgggaacggcggcgggtcctgccagacgaacaccgccacccagcagaccgtacccacggcgtagcagccgagcccggcggccatcagcgaccaggcaccgcgatcgcgacgcaccagcatcgcccgggccgccaccagcgccaccgccaccaggtagaatgcgtcctgccggagctcgtacagccaagtgaaccgattcatccagtcccgggcggccggtacgatcgcggcgaactgcgcgagcaggaagacagcacccaccgcgaacccggccctcagccagatccgcccgcgcgccggcaccatacccacagtcgcaccatcggttgatccccggcacacgtgagtggtcccgcgtaaatctttccgaaaccacgcccgttcaagaacgtgaaaaaggctcgcacggggcggtcggactccttgtgatcagcgccacatcggcttagcatccacttgcgtcaatgagaacccttccgggtttgccaccccgccttttctgcctgctcaccgggagaagcatccatgggcacactgtcccggcgcctgctcggtgccgccgcgacggccaccctggccgccagcaccatcatcccctcctccgccgccgccaccgccgccgagccgctgcgggaggtgatgttcgtcggcaacaactgggagggcaccgcggacgtcatcaaacccagcggcgacttcgcccggatcgggcggatcaacgtcgtaccggacaagacgcaacgccttgccgagatctatctgaacccgatcaggctggccttctacctgggcatccagcaggggccgggcgagggccacgaccagttggtcgacgacatgtactcgacgccggacggcaccgcgctggtcgcctcccggcccagcttcgccgacgtcgtctcgatcgacctgaccaccgggaagatcagatggcggttcccggtctccgggttccgcgccgaccacatggccgtctcccccgacggcaccaaggtggcggtgtccgcgtcgaccgccaacaccgtgcacgtgctggacatcaacaccggcgcgcagctcggctcgttcagcaccggcgacaaaccgcacgagaacgtgttcaccaacggcggccgctacctctggaacatgtccatcggcaacgtcgacaccagcctggacgcgccgggctgggactggaccaagggcgaccggcacatcaccgtcgtcgacaccggcacgtggcagatcgtcaagaccatcgacatgcgctcccggctgaacgccttcggtcgcagcgacctgtccaacgcgatccgtccggcggtcttcagcccggacttcgccaagctctacttccaggtctcgttcttcaacggcttcatcgagtacgacgtggccaccgacaagatcacccgggtgaagacactgccgaagaatccggccaccagcgacgaccgcaccacgttcgtcaacgactcgcggcaccacggcctctcgatgagtccggacggcagcaaactgtgcgtggccgggacgatggacgactacgccaccgtggtcgaccgcgccaccctgcatgagggcaccctggtgccggcggccaagccgtactgggcgacggtcagcggcgacggccgggactgcgtcatctcggagagcggggcggacgcggtcaccgcgatcgacttcgccaccggtcagaaggtggtctcggtgccggtcggcgaccacccgcagcgggtccgcctcgcccacatcccggcctcctggaccggcgtcaccggctgacccgtggcggacgcccaccggctgaagcaccggcgggcgtccgccgccgtcagtgccggccgcggagcgcgagcgggaagctgcccgcgccgaccccggtcagcgtccgggtgtactgccgcaggtaggtgtcgaggaacggcgaccggtcgccctgggtgggcacgtcccgcgccgggtcctgcagcgccaggctgagccgcgcccggctgacctggatggtgttgccgctcggggtgtccagccaggtgccgctgccgatcgtgccgacctgcacgccgagctggtggccggattccagggtccagtcggtcgccttgaggtcgacgccgacccggccggccttcgcgatcagtgccacgttctcgtcgaacatcaccgcggatccgccgggagcgacgtcccagagccgcacctggacgttgccgggcgcgctggcggtgagggcgatccgcggggtgccggtgatccgcagccgggtggtgaccggcgtcgaccaggtgaggtagctgtgcgtgtcaccggccgccggcagcggcgcgagcccccgcgcggtggccggtgcggggtcggcggcgtgctccatgtcccactgccgggcgccgggaacaccggtcgcggccagggcggagggcaggccgtcgtcgacgtactgcccgtcggtcagcttcgccgaggtcaccgaggtggggatgggccaggccggctgggcacgccacacgccggtgctgtcctcgatcgcgaacgccgggtcgtgcacggccgggaggacgcccttgaggtagcggtcgtagaaccgcatgacctcgtcgaagaatccggcccggccctgcagaagctgaccctggtcgtcggtctgattgccgcgtacgtgttcccactgcccgagccacccgcgttccacgccgtggtggttgccgaggtactcctggatgtcctccggcttggtgttgttctcgatgaagccctgagtgacgaacagcggggtgccggtgcccttcgcgcgcgccgccaggttgcgcgcccgccagtaggacgagtccgggtccgggttgtcgttgttcttcaggttgtcgctgaggcattccgggtggctggactcgtacgcggcgttcgccctgtagtggtcgctgtcgtcgggcagcggcgcgagcgtggcgatgccgttgtacgccgccggggtaccggtcacgttgggccggggcacgccgttgctgaacaggtagttgtacatgttccagaccggctcctgggcgaccaccgccttcagggccggcagccgcagatcgttgccgaccaggccggtgaccgcgtcgtacgacttgccgtacatcccgacccggccggtcgaccacggctggccggccgcccagcggatcgccgccttgacgtcggcctgctcccccgggcccacccagtcgaggcagccggtgctgccgccgaagccgcgcaggtcgaccatcacgtagctgtagccgcgggcgaacaggtcggtgccgctggtgaagtcggcgaaccggctggacggcccgctctgcgtccacccttcgggcccggtctggccggtgtgcgagaagtacggcccgacggcgacgatcaccggggtcctcgccccggccggcaggttcgccgggcgcagcacatcggcgtgcagttcgacgccactgtggtcggcggacgggaagtacacctcggtccacacggcaccctccggtacgcgcggattctgctcgtgggtgatgccgcccggcgccgcggcggcggccgtcgccgggccgccgacggcgagagccgccaccgtgatcagcgcaccggcggcggctgtcgcccgtctgcggatgctcatcaaacctccaggaaattgaccagtgtctctggaagccttgacgttatcggtcgcgcgtccattcgtcacgaggatcgtcggcgccgggcagagcgcggcggcctcgtgcccgtcggcggtccgggcggcatccggcccggcggtgggcagcaccgccgcgctgtcctgcacctctgcgcgccacctccgagaaggggccgcttccggtcgacgcccgcgtccccttcacgacaagtgattcaaattatccccgtcgatgatgagaacaccgtgagaacacacacgtcagggattacctgatagtgccgcgggtgtcggcgcgtcgtcggagagggacgtcctacggtcgcttcgtccggaaataccggaattgagaaaggtgaactcatgcgtaacctgatgcgcggaatcgtgctgtccggtctggccgcgacggccgggctcgccatcggcgccggcccggccctggccaccgccggcacgcccgtgacctgccagaagacagccacgcaccactgcacgacacacaccaccggcatgcccggcaagacccacgccaagggccaccacggccacgtgaccggcatgcacggcaagacccaccacggccacgcggcgagcatgcacggcaagacccaccacggtcacgccgcgagcatgcacggcaagacccaccacagcaccgcggtcaagccggccgccccggtgaccaagccggtcgccccgccggccaagccggccggcaacgcgcccaagaagtagacagcgcgaaccgggggccgcaaccccaccgggggcggcccccgtctgcggtcaggcggtgccggcgagcgaccagaccgcggacgcgatcgcgttggcggccagccccatgctggtctggctcacatcggtcaggttgtcgcaggaccggtggtaacacgcgcccagcgcattgaggctgcgcaccgagctcaccccggtgaccttcaccccggcccgcttgaaggcggcgtgatcggagcggtcgtcggtgttcagcgacgggttgacggtgatcccctgcgcgctgaaataggtctggaacggcgcgttcagtccgttcgactgaccctcgacgtacaggctccagccgaccgcccggccgttctccggcttgttgccgaccatgtcgaagttgaggtacgcgtcgatcttcttcgcctcgccgccggccaggtgcgacacgtagtagccggaaccgacgtcgccctgctcctcggcgccccagaaaccgaaccggatccgcttctgcggcttcagcttggcctgcgatatcgcggccgcgttggccagcagtgccgcgacgcccgagccgtcgtcgttgatcccgggacccgccgacaccgagtcggagtgcgcgcccgccatcaccacgtgggtggcgtcgccgtacggccactcggccaccacgttggccgcggccctcccgccggtggtgaagttctgcaccgtggtctgccagcccaacgcgtccagctgctgcttgatgtaggtgaccgtcgacgtgaagccggtgctgccgatcacccgggtgttgttgctggcctgcgcgaagctcatcagcttctgcagatgcaccatcgtggcgtcggcgctgatcaccggcggcgcgacggcgaccgcggcggccggcgtggcatcggcgtgggccgtaccggtgaccgccagcgcgacgctgagcgcggcggccaccccggcgtaggcatagttgcgaacccgcatcattcctccatggaggggccgcagcgagggggatgtcgacggccaccttggcatcgaactgtacggatccggcgccgcgatcggtgcataccaatctcaccatcacatcgggttccggaaccggcgccgactctcccgcggaggcgccggccgctggccggccgtggagggacccggtgaacgcggcggcgccgatgcgacaatgtgctccactgcgcgatcgacggcccgttcgcctgcggaatcggtccaccacagaatgggatccccagttccgcatggggattcgacggtttcgtcacgccgacggggccgccacccgaccagcgaagccgccggcctttccgcacctctacgcggcgtccggcacaaggccgtgatgggccacccgagtagtggattccgtgcagcccgccgacacgagagtcgtgtccgcgccggcgtggacatgcaggtcggaaccaccgaaccggatcaacaggccctgcatgacccagcccgccaccgcatccatcggcagctcgccggtgaggtcggtcccgccgggaaagtacgggtcttcggtcaccgcccagccggtcaggatccgaccctcgacggcagccagcgcgggcggtacggaggaacgccactcgtgcggccggccggtgatgacgggcggggtcgtcaggtcgacggtgttccacgtgatcgacaggtcgtcccagccctgccaggcgatttccagccggtcgccccgatcgaaccggaggaccaccggaccggccggctgccaccggtccatggccggatcccaggtgaccgcgccggcccgcagacgctgtccccgcagcgccagcaggcgggaccgctgacggcacagttgctcgggcgccggcatgaagccggaccgccacccggacatggcctcatcccagcgggctttcccggcggcgttctgcacagcgtggatcgtacggatcggcgcgccgggctgaccgccggccgcggcgtgacccgacggggctaccgcgatcgcggtagctccgcgccggagtggacctgcgggcgcaccttgccgagcaccgcggccccggccgccggcagcagtgggcggtcaccgtggcggaccaccgcggccagcgccggcaacgccagcatcagcccgaagaccgtgtcggccgccagcggatgatggccggcggcgtgccggacccggcgcgtcaccgagaaccacatgccgacgaccgtatgcgccgatcctgtgtgcactccaggctcgtcggtcaaccggtccggcgaccgtgggatgtctgccgcgaaccgcccgccgccgaggaagtacgcggggcagcaggtgccgtcgggtcgatcagcgtttccggccgacaccgccgtagagggcgacctgggcgtcggtgagtgtggtctgctcgtcaggccgccagcggaggatcgggaccacgccgggcgggacggtctcgagcttggcgaagaagcgggccagttcgtcgagtgaacgttgccggctgtgcacgccctggcggcgcatcacctcggcgaaccgggcccaggcttcgggatcgtggtcgccggtcatgtgggagatcaccaggtggctgccggtgggcagcgcgtccatgagctgggcgaccgtcgtgtaagggtcctgctcgtcgtcgaagaagtgcaggacggcgtagagcagcagggcgaccggctcgccgaggtcgagatggtcacgcgccgcggacaggatccggtccgtgtcggcgaagtcggcgtcgacgtacgccgtgtgtccctgcggcccgctggtcagcagggctcgggcgtgggtgagcacgagggggtcgttgtcgacgtagacgatccgcgcggtggggtcgatcgcctgggccacctcgtgaacgttgggcgaggtgggtagtccggtgccgatgtcgaggaactgccggatgccggcttcgccggccaggaagcgcaccgtgcgttgcacgaacgcccggttctgcaggggcgcggtggccacgttggggttgactttgagtccctcggccgcggccgcgcgatcggccgcgaagttgtccttgccgcccagcaggaagtcgtagacgcgagcggggtgcgggcgcccgacgtcgaggggatcggtcataggcgaagagtagtccgccattgtccgctatggattgccggctgtccgtcgatcgtggcggctccgcggcccggacccggctacgggacaggcacccagggtcgcgtggggacccgcttgccgcggacgatcaccgcgagcggcttgtcgagccggcccagatcggcccgcggatccccgtcgaacaccacggcatccgccggcgccccgtccaccagaccgggcagacccaggaacgagcgggccgtccaggaggcggcggcgatcgcccggtgcggcgacaccccggccgcgaccagcgcacggatctcccggacgatcccgccgtgcggtcgcgtgtcggtgccggccagcacggtgaccccggcttcgaccgccgcggcggtgagcccggcgtgggcgccggcccccggcacgtaccagctgcgggccgcgcgctcggggtcggcgagaatctgggtcagcgacccggtgatcgcggccagcgtcggggtgagcgcgatgccccgctcggccatcagcggcagcaggtccgggtcgaggcccatgccgtgctcgatcgaatccaccccggcctcgaccgcgaccaccccgcccgccgcctgctgggtgtgcaccgcgagccgcccacccaccgcgtgcacccgggccaccgcctcgcgcagcacgccgaccggcaggaccgggtcggccggcttccagtcgatcaccagcttggcccagccggtgcgggcggcctgcgcggccgcgacggccggcaggtcggcatgatcggggcggcggccccagccgtccatgaactggccctgctgggcgatccacggtccggcatgctgggcgcgcgggctgtcgtccgccgccccgaaccagtccggcggatccccggccagcccgggcgcccggatcagcgtgaccccggcgtccaggtgggcccgcagatcccgccgcaggatgtcgtcgtcgagcggccgcccgggctcctcggcgccgggatgggtgtgcgcatcgaccagtccgggcagcacccacccctcggccaccgactcggcaccccgcaccggatccgtggtccaccggtccccgtcggcatagagatcgatcggctccccgtcaggaagcccgaaaccccggacccgcagcactgccatggacggtcatcctgccgcacccgtcccaacgggccccgcgccacccctgcgcgagcagcggtgtcaggctcccgcggtgaagtgcgccgaagcccacgaccgcctcgccgtcaccggcgctcaccgggacgagcagtcccggtggcatgaagaatcgctcccccgtgcaggtcggcaggcgtcggtggctcgaccgccggtgacggcggcgtgcgcaggaccgcccagcaggccgcgcccagcggcaactgcagccagcaggagagcaggcggtaaagcagcaccgcggcggtggccggcgcggccgccgcgccgcccgcggtggtgacggccaggatcagcgccgcctcgatcaccccgatgccgccgggtgtcgccgggatctgccgggccagctgcgcccccagataggcggtcccgagcaccgcgatcggcacccgcaggttcagcgcgtgcaggcacgcgatcaggcacaccaggtccgcgagccagttcagcaccgcgagggccaggatcgccagccattgcggtacgcggacagcggcgctcgccaccagcgtctcgtgcacgccgcgccgcacccgcgccagagccgtggccggctcgccggccggcggcgggtggcgtcgcagcgtgcgcacgccgagcgccagcccggtcaccgccgccaccatgatcgcgatcacccgggggtcgccggcctgcaccagcgcatcaccggcgtagagcacggccagcccggtgaccgaggccgcgccgcagagcgcggtgaccgtggccgcgatcgggcggctggcgccgcgcgcccggaactgccggaaaccgtaggccgcggcgaccgcggacccaccgggcagcgaggtcgccatcgccgagcgcaccagggtgaccgccaccgaggtgcgggccgcgatcggcacgccgaaggcgcccagcagccgccgctcctcctcggcgaacgcgacggtggagatcacctgcagcagcacggcggcggtcagccagcccgccctggtctgtcgcagcgcggtccaggtggcggccaccccgggcaggtgcccctgcagctcgtggacggcgaggcagccggccagggccaggacggggagtttccaccagccgccacggcggttcgcgggggccgtccggggcggctggtcgcgtacagaatcggtggttgtcattgatcctctgcggtgcggatcgtcgcggcgggacgtcttcgaggatcggcggcgagggtaagggaagtgctcgggggcggctaagaggcggctaagaattccggctcctacatgccgtaggtttaccgggaccgaggcggggtaggtcaggccggaactcgacggagggaaccacatccgatgaccgcagcgctgggcccttcgtttctcgcgccggaatggctgatctcgacattcggactggtcgggatcctcgccatcgtgttcgccgagtcaggactgctgatcggcttcttcctgcccggtgactcgctgctgttcaccgcgggtctgctgatcgccggcggcacctatctgcaccagccgctgtggctgatgtgcctgctggtgtcggtcgcggcggtcgccggcgaccagttcggctatctgttcgggcggcgtttcgggccggccctgttccgccggcccgattcacggctgttcaagcaggagaatctcggccgggcgcgggacttcttcgccaagtacggcgcccggtcgatcattctggcccggttcgtgccgatcgtccggaccttcaccccgatcgtggccggcgccagccacatgccttaccgcacgttcctgagctacaacgtgatcggcggcaccgcgtggggctgcggtgtcacgattctcggctatttcctcggccagatcgccttcgtgaagtcgaacatcgaattcatcctggtcggcatcgtggccctgtcggtcgtcccgatcggcatcgaactgctgcgcggccggcgccgcgcccgggctcagcgcacccgctgagcgcggaactgcaggcgcggcgcggcatagaactcctgcgcctggatcagctgcagttcgcgctcccccgactcgaacgtcgtcttcaaaagatcgaagacgctggacacggtacgttcgagagccgtcgccgcctcgcccgtggccacgtagtgcgcggtgaacagggcggccgtcacgtccccggagccgttcgccttgaacggcaggtgcggcgtgctcaccagccatgctccggcgtcggcgacgaccagcatctcgatcgtccccggctcccggtccggccgctccacgctggtgaccagcacggtcgacggacccatggcccgggccaggtcggccgaggccagggtcgagtcgatgtcggccggctcggtgccggtcaggaagcccagctcgaactggttcggcgtgatgatgtcggcgaccggcaccacccggtcgcgcagcagcaccgggatctccggcgcgacgaagcagccggacttggcgttgcccatcaccgggtcacacgcgtacaccgcgttcgggttcgccgccttgacccggcgcaccgcgtcgatgatcacgtcggcgatcccggcgccgccctgatacccggacagcaccgcgtcgatctgcgggaacaccccgcgctccgcgaccccgagaatgatctcggcgacgtcggcgggcggcagcagcggcccgcgccacgccccgtacccggtgtggttggagaagttgacggtcgggatcggaacgacctcgacaccgatgcgctgcagcgggaacacggccgcggagttgccgacgtgaccgtgcgcgaccaccgactggatggacagaactttcatgaccgccagcctaaagtccgtcagacggcgacggctcgcgggcggttgcggaccgccgcccaggccatgaatccggccagcaccgccagcaccacggtgatcagcagcgaggtgaggatcgcggccccggccgggtagccgaggccgagaccctgcggcccccagccgagtgaggtggtgccgcgcggcatgccccggccctaaggcaggaacctgacctcggggaacgcccggctcggcccgtccagcagccggctgtgccgcccgcgcagatgctggtcgaagaaggccagcggatacgcctgctggatccgcaccgcccggcccggatccagggtgccgatctccccctgcagcatctcgtcgctcaaccccacgatcggggccacctgggcgtacagggtctgataatcggtgtacgacggatgcgccgccccgtccgcccggatggtgagccgccacccgcgcagatgcgaccagaacgcggccaccgccggatggtccgcccggttgaagaaggcgctcatcagcagcaccggccgatccagatcggtcgacggcatcggatcggactccatcggcccgtccaggatcagcccggcccgcacccgccggtcggcggccatcagcagcgcggtcgcggtgccacccttggagtgcccgtacatgccgatccgccgcacgtcgatcgcccggcccagcccgtccggcagcgggcggccgtccacatccggattcccgccgcgcgcgaccacctcgagctgatcgatgacgaacccggcgtcccgggcgaagtccagcggcagcatcagcggatcctccaccggttccaggacgcggccatccgggaactcggtgtacgcgtcgaaggtgtgatcgacggtcgccaccacgaaaccgtggctcaccagctcctgcgcgatgatcgtcgtctccgagcggtgatcgtgggcgccatgcgaatacaccacgaccggaaaaccctgcggtgtacgccgtaccggagcacccagtcgtcccgacgtgaacggcgcgagcaccgcgtcccggtcgaaatcggccgacgcgagcagcagccgcatcggctcggcgtccagccacgtctccaccggcccgggccggctgccctcggccggataccagatgttggccatcagctcgcgcggccgcccctgatgggtccgcgaccggtccacgagatgcagccgcgtcgtccccaccggcagcggcccggtcggccgcggcaaccgcagccgcggcggcccggaactcaccgccgcgttcgccacacccccgaacggcacgctgatccctgccgccagcgtcgccccgagcagccctcgccgcgaaatacccacgatccctccccatctgcgtccacttccgacgccgacaacgctagggatcgaccggcccgcccacatcctcccgacgatgacagtcgatggacgcggtccgactacggcatacatcgaaagaagtagcgcccctcgccgcgcgcgaggccgccgcctagctagctagcccggcccgcggacacctccgcaccgccccggccgccgacctcgcccgagccgtccgcacccaccgcgaaaccggccccgcccccacggcctgcaccgcgctgcgtcaggccgcccgccgcggaccggcaggctcagccacggtggtcggccatccctgcgttctgcgtcagcgtttcgtcgggccacggatccggcagcggccccgccgagggcgagggcccgtaaggcgtgtgacccgctcggaaatgccggagatggttgaccgacgagatcaggatgcgctcgaagagtgcgggttcctcatggagtcgtccgctgtaccggtccgggtgctgctccaccttgaggtcggtgaagaccgccgactcgccggagccccggacgcggacctgcgcctcatagacctggaagccggtccacgaccgccacatccgcaccgtgtccgcgtcgtcgagatgcgccatccagcggatttccatgtcaaagtagccgagcccgtcgcggagcaatccgatggtgtccgcgtccaggatgaggcccggccgatgaccggtcaggtggagagccagcgcgggacgaaccctggccgcactcggcgcggtgaacaacggacggatgtcctcaggcggcatgaccgcattctcacctacgcttgcggcgagcaccaaccgtgccaggattcacctgtgccggctgccgtgctgttcgacctcgacgacacgttgatcgacgagacgaccgcgtcccgcgatgccgtgctcgcttgggccgcggagctggagctcaccgggccgggagccgaccagcggtgggcgcggatctcggcccggcactactcccgctaccagcgacgggagctctccttcgcgcagcagcggcgagaacgggtccgtgacttcctcggcaccgccctcaccgacaccgcagcggatcggctcttcgccacctacctgcggcactacgaagccgcctggaccgttttcgacgacgcggtgcccacgctccgccgagcacgggagtccggcctgcgggtcgccgtgctgaccaacggtgaacatagccagcagcaccacaagctcgaacgcctttccctgctgtccgagatcgacctgctggtggcctcctccaccctgcccgccggcaagccggaccccggcgcattccgccatacggtcaaccacttgggggtcgagcccgtcgacgtcgtgatggtcggcgactccctggagaaggacgtcttcggagcccgagcggcgggcctgtccgcgatcctgctggaccgggacgggacccgggccgggtccggggtcccccgcgtacggtccctcaacgacctcgtcttcacccctgacaggaagatgacgcccacgtgagctacagcttgatccagtagtgccgcaccggaccgtgcccgttgtcgccgacgtcccgaggatgccgccgtggcgctcgatcgtcttcgccgaggcgatggtgtccacggcgcacacgatcggaagtcgctccagcccgagctctcgcgccaggttgagcagcccgcagcggggcggtcgcgcggtctcggcctcaggtcctgtgcgcgggtgccgatcgggacactggaaacccctcgccgaacggagctgcgacgtggccgtacagcggtcgaatgcgatgccggcacggcgactgggcacggggtcgctgatcgagcggatcgtggcggagcgcgccatctatccggtcttccagccgatcgtcgatctcggctcgcacgcggtcgtcggggtcgaggcgttggcgcgtggtccggcgggctctgccctggagactcccgacgcgctgttcgccgccgcgatcgaggccggtttgctgaccgagttggaccagttgtgctacgcccgcgcgctggagacggtccgggacgccgggccaccggtgccgccactggtgttcgtcaatgccgagcccgccggattgagccagccgatgtctccggacctcgccgctgtggtccggagcagcctgccttttcggatcgtgctggagttcaccgaacgcgcgctgacgagccgaccggctgcggtcctgcgcctcgccgacctcgtccattccctcggtaatgccgtcgcgttggacgacgtgggtgccgaccctgcctcgctggcgtttctgccgctcgtcgagccggatgtcgtcaagctcgacatgcatctgatccgcgatccgtattcaccgaaaacccaggcgacggccgccgctgtcgtgggatacgccgaccgcagcggagcgacggtactggctgagggcatcgagacaccggacgacgaggtgaacgccgcggctctgggcgcgcgatgggggcaggggtggttgttcggtcggcccgggccgttggagatgatgctgggccgcgagtacgcgcagtcgccggccgtgtcccgattcgtgccaggcgttgaaccggtgcacggggagacgccgttcgccatagccgctcaccgacagccggtgcgcgtggccgggccggacatggccgacgccctgatcgaccacgtcctggcatccatcggggatcgcggtcggcagagcatcgtgatgtgcgccatcaatgggccgggacagccgtcgcgatggcttccgagactcgtcgccgcggccgatcacttcacctacctgggtctgctcagcggctcagcgttgccctccgtcgctgatgtgcaggtccaacggatcgaagagagtgacccgcttcgcgaagagaccgtgatatcggtactcacggaggacgtttcgatggcgctgtgcctgaaatcgatcggatcagaatcggccggcgatcgcgattccgttcaattcgtctacccgcagagcaggcacatcgtgcatcccatcctgcgtaacatgatgcgccgcttcggcacctggtgaagagcggtgacggtcgcgacgctcagagaaagaccgaggccggcatcacgcgctgccgatccctcgtcaccgggaccggtccacgccgaagggggtggcaccgcgagcgacgcggcaccacccccctctcccccgtcagcgggccgggatcaggcgtgtcgcctggggggacggcggggtgccggagccgcgccggccgcgtcggacccgggccgcggtggccaggcgctcgcggtcggcttcggcgatcagggtgcggcggtggtcgtcggcgagggtgagtgagatggcggggtggatcagcatgaccggctccttcgtggtggtgatgagtcgatcctcggatttcgcgagggctgccacatcgggagcggatgcgtatcttcgctggtcaccgtggtttagagggggctcgcggcgggactaggtatacgtacgcggcaagggtcttcagggttttctcatgatggatccggcacaatgcctggtcatggctgtcgcgtcacttacctacgccgaggctgtggtcatcggactgctgcagggcgtcaccgagctcttcccggtctccagtctcgggcacagcgtgctgatcccggcgctgatcggcgggcggtgggcgcaggacctgagtctcggcgccgaccagtcgccctacctggcgttcctggtggcggtgcacgtggcgacggccgcggcgctggtgtggttcttccgggccgactgggtgcggatcgtgcgcgggctgttcacctcggtgcgcgaccggcggatcgagaacccggatcagcggctggcctggctgctgatcgcggcgaccattccggtggggctggccgggctggtcctggagcacaccgtgcggaccgcgctgggcaagccgctgccggcctcgatcttcctgctcgtcaacgggctgctgctggccggggtggagcggatccggcggcggacgccggagccccgcgtgccactcgccgtcggcagcgacggggtctatgtggggtcgaccgcccagcagcacggcggggtctcggcgcacggcggcgacgtcgagtccgatcaccggctcgccgggctgggctggaagcaggcgatcctgatcggggcggcgcagatcctggcgctgctgccggggatcagccggtccggcgtgacgatcggggccggcctgctgcgcgggctgtcccacgaggacgcggcacgcttcgcgttcctgctggcaacgccggtgatcgcggcggccggggtgctgaagctgccggaactggccgggccggccgggcacgggatcgccgggccggtcctggccggcagcctggtggcgggggtcgcggcgtacgtctcgcttcggttcttgaccaggtatttcgagacccggacgctgaacccgttcgccatctactgcgtggtcgccggcctgggcggcctgatctggttcggcgtgcagtagtcgccacctcccgcgcggggccgaacccgcttcacggccccggcgggtggggttcgtgcgcgaggaggtagtcgcgcagcagggcgtgccggaattcgtagccccgaccgaccgcccgcaggatcccgcgggaacccgcatcctccaggaaggccagcagcgcgaccggggtgccgacggaccggtgcaactgcaggaacgtcagccgggtcggccaggtcgccccggagatcaggcaggcggcgccaccggccaggccgccgaaggcgagcgacgtgccgagcagcgccgcgccggcgggcgcggtcatgctcgagccggtgaagtagtggtcgtacaggaccagcccaccgagggccgccacgtaggcaccgacgaccacactgaccacgcgggcatagtggcggtcccggcgccacaccagaaggggatccgccgacatctcctcgtcggtctccggctggccggcgcccagtatccagagggcgaggaagatcggcaggacgaacgggaccacgcagaagccgaccagcagaccgaacgcgtacggcgcggtcgcccgtgagaacaacgaccgcagcggccgccgtcgtcagcatcaggccgccggccgccaagcccgggcgccctacccgtgtcgccattgccggcactccctcatccgcgccggtctcaccgttccgtcgacgggagaccgcgaaggcgcgccggtcgatgtatcaccaacggaaagatcccatcaaaccccgggggcgcgggcgccgcggctcaggcgacgtcgcacaggtcgcgcagggtgagcagagcggggacggtcagcaggagcatcgtcaccccgaggacggccgtggtgagcgggcgcgccgagtgcggggcggcggccaggacggtggcggacccggcggccagggccgcggtgagggtccacaggccgtagctgaggcggggcgcggtggtggtggcctcgcccaggtcggcgatcaggcggcaggtctgcaccaccccggccagcagggtggcccaccagacgccgagcgccaggtggcggacggccgggggcacggcgaggccggccgtgttggccacgcagacgatggccagaccggcgagggtgggcacggcgaggcgccgcacgacgtacgccagcaattgccgcagggccgcggccgtgcgccgcgggaacggcgcggccagcagcagcgccgcgctgatcagcaggtcgctgagcagcagcggccgggcgtgcgccagcgacctgggcagcagcgagtcctcctcggcgaggaggtggccgagcagccaggcgaccccggccagcaggaacacggtgaccgtggcccggctgcggcgctgcagcggggaaccggccggccacagcaccgggtgcagccacatggcggcggcgccggccagcaggttcggcacggtgcgccagccgccggcgcggacctcgtcctccaggccgctcccccagcggtcgcgcatcgggcgcggatagcagcggaccagaccgcgggccccgatcatgccggccggatgccgagccggcgcaggccggagtcggcgacccgggccatcgcgcgcagctcccgctcgatcgccgcgcggccctgcgcggtgagccggaccggctgccggcgcccccggccgggcagcgactcgatcaaccctttggcttcgagcctggtcagcgcgccgtagaggctgccgggaccgagccggtcgccgatcagctcctcgatcgcgacgttgatcgcatagccgtgcagcgggccgtcgagcagcgcgctcatcaccaagatctgtgagtcccgggcttccacgaaccacatcttactacttgtcacgtagtacgcgttgcgtactatagcgccgtgaccgacattcccttccgtgccgagaacgtcacgaaacggttccgccgcaccaccgccgtcgacgcggtgacctgggcgccgcgcgccggccgggtcaccgcgctggtcgggctgaacggggccggcaagtccaccctgctgcggatgctggccgggctgatccggcccacctcgggcacggtgacccggcaccggccgctgtccgcgatgatcgaggcgccggccctgcacgccggcctgagcgcccgccgcaacctggagatgcaccggatcctcaccggggccggccgcgcccggctggccgaggtcgccgagctcgcccaggtcaccgaggtgctcgaccggcgggccggggcgctgtcccaggggtatcggcagcggctggcgatcgccgtggccctgctgggcgcgccggccgcgctgctgctcgacgagccggccaacgcgctcgacccggaggccgtcgtccacctgcgacacctggtgcggacggtggccgcgcagggcaccgcggtcgtcgtctccagccaccagctgcgcgaactcgacggggtcgcggacgcgctcaccctgctgcatcgggggcggatccgctacgacgggccgttcggcgacttcgtcggtccggcccggctgcgggtccgggccagcgaccgcgaccggctgacccgcgcgctgcacgacgacggtctcaccgcgcagcccggtggcgaccacctgtggatcacccccggccggcccgggcccgaccggaccgcttcgcgggtcttcgcggccgccgcgcgggccggcgtcacgctcgtcgagctgagccatgtcgccccgacgctcgaggaggccttccaccagacgattgcggaggtacgtcgatgatcagctcctaccgcgccgaaacgctgcgggcgctcagccggtccagcgccgcgttcctggcgctgtgcacggcactgacctggttctcgatggtgaacgccggcccgcaacaccagaccccgctgtggggcttccgccaggtcgccatcttcacggcgaccctggtgctgggccgcgccgccgtggtcgccgccggcgatttcggctccggcacgatccgcccgtggctgatctcggcacggacccggcccggcacgttcctcggcaaactcgccgcgtcggccaccttcgggctggtcaccgccctggtcaccggcctcgccggggaagccgtgagcggcctgctcggcccggtgccggccccggccgcgatggcactcgcggtggcccagctcgggttcgcgtgcgtggcgctcgccgtcttcgggcacgccgccggcatgctgacccggtcggtgccggtggcgctgaccgtggcgatcggctggatcctgccggccgaggcggtgctgcagggacactcggcgaccgtcgaccggtggctgcccggcaacgtgctgcaggacttcacgctcggcggggtcgcggccggcagcacctgggccggcgcggccgtgcacgcgacgctgccgttcctggccctggacgcgatcgcgctcgcgctgttcctgcggcgggacgtgaacgactgatgcggcgggcgccgatcgtggccgcgctcggggcggccgccgggagcgagacgctgagcgtgctgtcgacgcagattcgcgacgtacgggcgagcagcccctggcagagcgacccgtacaacacggtgctgtcggtgacggtgttcgccgtgccggtcctggccgtgctgatcgccggacggctggccgcgtggcaggcggcgggcggcggaaggcgcggacgggaacaccatcgggcgccgggcgacgacgaccgcgaacggcagctgcggcgggcggccgccgccctgctcgggctggccggcgccaccgcggtcatcgaatggatcgcggtcgctctccggccacacccctggcgcggctggaccggcccgctgatcggcggcctcaccgtcgcgacgctcgcgctcgcgctcgccaccggtctgctgctgcgccgccgcctgccccggcgcgcgccgggaatctgggcctcggactggctgtcggatctggccggaccgccgatcccgcggccgctgaccggatggatccggcggcacgccaccgcggtgttcgccgggctgagcgtgctggccgcggccggggtggtcgggtcgctggccgtcggcgaggcatggaccgacccgctgctgatcggctgggcattcgtgctggaggcaagcgcgtggttcgccctggccgtactcggcaatcggatctgtgtcttcgtcctgcgcccgccgcaccggacggacgccgcggcgatcggcttcagcctggggatgctggtggcgaccgcgttccacggtccgatcagcacggtcccggcgctggtcgcggtcaccgccggcgcgggactggtgggtgccgtgctggcttcggtccaccggccgcggatcgcccgcgtcccgggatgacgggcgtcccggccgccccggcatgggaagcccggcaggtcaggaccgcgccggggccggtgacgacgatggcgaccggacggcccggggcgccggtgtcgagggtcgggatcacggtcgcggcgggcggctggcacgtaccgcccatcgggatcctgaatcgatattctctcgtcgtgacgaacgacaggcggcggcccggcgccctggaagcggccgtgatggccacgctgtgggcggccgacgcgccgatgaccgccgcccaggtgcagctgctcgtcggcgacgacctggcgtacaacaccgtccagacgatcctgatccggctgcacggcaaagggcggctgcggcgccggcgggccggtcgcggacacgaatactggccggtggaggacgccgcgacagcggcggccgggcggatgcgggccgcgctgccgcccggatcgggacgccacgccgtgctgcggcagttcgccgccaccctcgacccggcggacgccgccctgctgcgcgcgctgctggccgacagtgacggcgactgaacccgcggccggtgtcctgcgtccgctggtgccgaccggaggcccggcggcttgaccgtcgaacagcaggcggccgccgtcgccgacccgtggtccggcgtacgttggaccgatgatcaccctgcctgaggggctgctcgccctcctgcgccgcccgagcccgtgcttcatcgccaccgtcgacccggacgggtcgccccagctcaccgagacatgggtcgacaccgacggtgagcacatcctgatcaatacggtggagggcttccggaaggtacgcaacatcgagcgggacccgcgcgtctcggtcatcgtgacggatccggacgacgtgaccgactactactcggtgaagggacacgtcatcgacgtgaccacgaaaaacggcgccgagcacatcgacgagctggcgcaccggtatctgggccggccgtacccgtggttcggaggccgcgaccaggtgcgcctcatcctgaccatcgccgccgaccggatcgtccacgcgccgcgcggctgagcccgcgccaccgtcggtaccgccgtgccggaggtgagcctgcgccgggcccgcacctcaccagcagtgatgtcgacggacgagggcccgtcgacatcaccccccgttgctcgaatacaaaacgtgcgttgaccgacgcggcatatccgctcaacgggcgttaagttacgccccaggaacacgactgtccacaggagaaccgcggcgaggctcgacccgatctgatatgggacactcggcacaacgtcgacggcggagggatgatgaccgaagtcatgggtgccgcgcccgagcccaccggcctttccagcctcgcggcgcgcctcgaccacctgttcgacacgatccgcccgaccgctgccgagctcggggagcatgaccagccgggccggcgatacaccaaccgggagatcgcggacagggtcaacgcagtggcggggacgatgcccggcgcggtcaccatcagcgccgcgtacatcggggagcttcggcgcggtgtggccaccgacccccgaacctcgcacgtgcaggcgctcgcccgggcgttcggtgtcgatccggggtacttcgtggacgacgaggcggccagacgggtccaggagcagatcggcctgctcaacgagcttcgtcggatggacgtccggcaggtggccttgcgccgcgtcctgcaggacagtggcctgtccacggcgagcgcgctcctggtcgaacagatggtggcccgtctgcacgaggtcgagtccgatgccaccgatcggtcacgtcaccaccgcgactgatcccgtccgtaggatcgccgaccgccgggaaggagggccatgagcagcagtcaggacgatgaccgggaattgcgtcgccgctgtcaagctgtcgtcgacgccctcgagatcccctacccgttcgacatggccctgctctgtcagcgcatcggtggccaccgcggacgcccgatccatctgatcgcgatgccgatgccgcccggcgggccgtccggcgtgtggatctccgcgcgcgactacgacgccatcttctacgaggcggacaccggccgaccccaccaggatcacatcatcggccatgagctcggacatctgctctgcggccacgagcgtggcgtcggggacgacctcgcgcggatgctgctgcccgacctcgatccggcgctcgtgcggcgggtgttgcagcgcaccggctacagcgcgatcgatgagcgtgaggcggagatggtggcgtcgctgctgttgcgagcggcgcaacgcctcggcacgccgccgcccgcggtcgccccggatgccgccccaggcggcgcggccgaggtggtggcccggctgcagcggtcgctgggccgtcccgtcggcgacctcgacggctgacggcgcggacatggatttcggcgcgcgccgcgtcgctgtcgggccgcaaggccccatgctccggcgaccgatcgcccgggcctgagggttcctggcatgagggccggcgtccacgggggaagacgccggcccacggtttgccatcatagcggcaatggtcgatgcttccagcgtcgaccgttccaccgggggcgccgctgcccgtcgctgtaccggagatgactgatgacggctcagagcctcaaagctgtgctgtttcccctgtcggccgccatctgcctgctggcgttgacctacaaggcagtggacgccaggcgacgtccgcgcgacccggcactgatcgccctgctgatcgcgttcaccggcaagggagtctcgttcacgctgtccacgccggcggtgtcggcgacggtggacgcggcaacgggcgtaccgaacctgggcgcgctcggcatccatctctgcggcggcgtgctctccagcgccgccttcctcgccgccctggtccactgggtgtatccgcgagagcgggtggctcgtgcggtccgggcccgggtggtggtggcggcggtcatcgggatcgtcatggtggcgctgtggtggagcgcctcacgcggcgggcggcggtcggcgcacttcctcctggacaatgccggcgagcccgcggtcatcgcctacctgcttctgtacgtgaccgctttcggtaccgcgatgaccgagatcgtccggttgtgccggcggtacggtccaccgtccggctcgagctggcttcgccggggtctcgccctgaccgccctcggcgcctcggcatgcatcgtgtactgcctcaaccgcgcgttcgtcatcgtggcggtgcagctcgggtggcacccgttgaactgggagatactcaccccgatcgccaacacggtgggtatcgccgggatcgccggcggcctgaccatgccgtcctggggccctcggctggccgcggccgtgcgctggtgccggcattaccgcgatcaatggcagctgtatccgctctggcgggacgtgtgtgcggccgtccccgccgtcgccctcctgccgcccacctccccgctgcgcgaccggctgcatccggtcgacgtcgagttccggctctatcgacgcgtggtggagatccgcgacggtctcctcgccctgcgcgcggatcccggcctggggaccggcgaccgggaagctctccggatcctggacacgtccctgaacgacagcgagaactacgctgacgagctggcgtggttgcggcgccgggccgcggagtaccggcggcgcacgggcccgtcaccggaccgcgccgacaccgactgtcgcaccgaccccccggcgaccgccggcggtgcaccgaagaccaccacctggaggtaacgcttccatgaagtaccgaaccgtgggtgccgcaggccccaccgtgtccgccatcgggctcgggtgcatgggcatgtcgatctcctacggcccgccggacgaggcggagtcgatccggaccctggaccgcgccgccgagctcggcgtcaccctgtacgacaccgccgacgtctacggcctcggggtgaacgaggaactgctcggccggtggctggcccggcggcggcccgaggtgctggtgtcgaccaagttcggcctgcgccgcggggcagacggacgcgtttccgaggtggacaccagccccgcgtacgtgcccgtggcgtgcgacgcgtcgctgcgacggttgggcaggcagcacatcgatctgtactacgcgcaccgtcgcagtcccgaggttcccatcgaggacacggtcggggccatggccggcctggtggccgccggcaaggttcgctacctggggctgtccgaggtgaacccgaccacgctgcgccgcgcccacgccgtacacccgatcgccgccgtccagctggaatactcgctgttcacccgggacgtggtggccggcgagatggccgccacctgccgtgaactcggtatcgccgtggtggcctactgcccgctgggccggggcatgctgaccggacggatcacctcgcgcgatcagctttcggaagccgacgcccgactccggtggccgcgcttcgacgccgacaacctggtccgcaacctcacgctggtgaccgcggtggctgaggtcgcgcaggagatcggctgcacgcccgcccaggcggcactggcatggctgctcggtcagggcgagaacgtcatcccgatcccgggcaccaagcgggtccgctacctcgaggagaacgttgcggcggtgacggtcgacctcacgcccacccagctcgatcgtctccgctctgcggtcccggccgacgcggtggccggcaccagatatcccgcacaagccctggcccggctcggccactgacggcggacgcacggctggcgaagcggctgatgtcaccgatgtcgtcgttgcgttttccacacgctgccgtccgaaagggctacgcggtggggaggcggatgcgcatggcggcgccttccgggaggtcgtcgacggtcagggtgccctggtgtgtggtgatgatgtcgcgggcgatggccaggccgaggccggagccgccgccgccgcgggagcggctgtcgtccaggcggacgaagcggtggaagatgcgctcgcggtcggcgggcgggatcggggggccgtcgttgccgaccacgatctcgccctggccgccggtcgcggtgaggctgatggtgacgcgttcgcgggcgtgccggacggtgttgtcgaccaggttgcggacgacccgggtgagctgatcggggtcgccggtgacccggaccgggctgacggcgccctcgatgcgcaggtgggggtgttcgacggcgacccggtcgcgttcggcgaagatcaggtcgtccaggtcgacgtcctggcggcgtggagagcgctggtcgtcgacccgggccagcagcagcaggtcgtcgaccaggcgggacatgcgggcgctctcggcccggatccgctgcacgtggggcgcggtggaggcgtcggcggccagcaggtcggcgttggcgcggatggtggtgagcgggctgcgcagttcgtggctggcgtcggcgacgaatcggcgctgcgcggccgcggacgcctcgatccggtccagcatggtgttcatcgtggtggccagtgccgcgatctcgtcgtcggcggcgggcagcggcagccgggcatgcagattggtggcggtgatcgtggcggcctgccggcgcatcgcttcgaccggttgcagggtgcggccgacgaagtggaaggtggcgacgccgaccacgacggccagcatgggcaggccgagcagcagcgcggtgacgatcgcggcggtgctgtccgagacgacgtccaacgactcggcgaccagtacggtgtgctgcccgtcggcggtggcgacgccggtggcctcgatcagccagggttcgccttcgccgatcggcaggtaggtggtttcccgcgcgtgctgcccggccggtgggcgcagctcggacatgggcggcagttcggcgatggcggcggaggcgtcgacgaccgtgccgccggcggtgagcacctggaccaggcctcggccggcgcgggacgagtgcagcgtcacctgcagggcggccgcgtcccgcggggtcagggccgcggtgacctcggcggtccggtcggaggccgccgagtcgacattgtcgagcaggatgccgcgggcgacgaccagcaggatgccgccggccagcaccgaggcgaacgcgacgacgatcccggcggccagcgcggagcgcatccgcacgccgagccgccgccgcagccaggacggcatcaaccggcgccgcagcgaggacggcccccgccggcgccgtagcgaggacagcatgaacgtcacgttattccggcccttccggcgacgtacggtgatcgcatgcgggttctggtggtggaggacgaggtcacgatggcggagacgatccgcgacgggatcacccgggagggtttcacggtcgacctggtgcacgacgggaccgagggcttgtggacggccaccgagcagccgtacggggcgtacgacgtgatcgtcctggacatcatgctgcccgggctcagcggctacgaggtgtgccgccggctgcgggcggccggggtgtggacgccgatcctgatgctgaccgccaaggacggagagtacgaccacgccgacgcgctcgacctcggggccgacgactacctggtcaaaccgttctccttcgtggtgctgatcgcgcatctgcgggcgctggtccggcgcggcgccccggaacgcccggccgtgctgcgcgccggtgatctgaccctggatccggcggagcggcgggtgctgcgcggcgacaccccgatcccggtcaccccgcgggagttcgcgctgctggagttcctgatgcggcaccgcggtcaggcgatgaccaagaccgcgatcatcgagaacgtgtgggacgcccacttcgacggcgacccgaacatcgtcgaggtgtacatcggatatctgcggaagaagatcgaccacccgttcggccgggccgccatcgagacggtccggggcgccgggtatcggctcgccgacgagggttgagcgggacatcggtcgtacgctaagcggctgttcctgagagcgggttgaagaccgcggtgttcagcgattcctcagcgcccgcgggtcaccgtcagcggcatggacatcgagcacggcccctgtgtacgccgtgaagaccgccgccgcggccttgctcaccgccgaggccgccgcccacgccgcgcccgccgtcgccgcgatcggcccggtccgccgccgcctgttcccggcccgctccggtctcggcgaccccggccacgtggcgctcaccttcaacgacggcccgcacccggtcgccacgccgcggttggtgcggatcctgcaagccaaccgggtgcgggccaccttcttcctgctcggcgcgatgaccgaggagtatccgtgtaccgcgcggtgcgccgcgggctgggcggcggcggcggcggcgggacgatcctgctgcacgacagcgaccacagcgccgccccggacagtttcgcgtcgacgctgggcgcgctgccggcgatcctcacccactgccgggcgcgcggcttcaccgtcgggccgttgcgggaacatgccgtccgggcggaatgaccttgacgcgagcgggcatcatcaacggcatgacagggtggatcatgtggcgtcctcccgccgccgacgaggagatcgcccgctgggcggtgaaccacccgccgcagctgcgtgacctgcgcggcgacctgcgccggctggtcacggcgggccggctcccgacggtcgcggacgccgacgacctcgccgaccggctggtcatcgtcgccaccgaactggccggcaacgcgctgcggcacggccgcccgccgaccgccgtggtgctgttccgttccgacgggcgcctgatcatcgaggtgtccgaccatgatgcggacgccgtgccggcggtcgacccgcagcggcccccggcggccggcgggatgggcctgcggatggtggagcggctcgccgagcgggtcggctggtatccgtcagcgcccggcaaacacgtctgggccgcggtccggctcagcggcgcctgaccggagcgtgtcgggccggggttccggaatcaggctgcccgccgcgggtccggcagcccaggagcgggtggtccgtctgtagcggtggatcacggaaaccatcagcaggatgacgaccggcccgaagatccacggttgttcggccatgcgcagcggcaggaaacggtaggcgagcagcagcgtggcgaacaccgccacgccgtgcccgaccgtcaggattccccatcggtcccagccgcgcgcctgggagcgcagcgccgcctcgacggtgagggtgaagaccacgccggcgacgatgtccgcgccgtagtggtagccgaacccgagggtggcgccgagggtggcgatcagccagaaggtcccggcgaatcgcagcgcccgggggccgcgacgggaatggaggaagatcgcggtggcccatgcggtgtgcaggctgggcatgcagttgcggggcgtgatctcgtcgaacggcatgtgccgcggggcgccgatcgcgggcacgatgtccggccagaggtgggccgtcgcccactgcccgccggcggcgccgtacgcgaagaccggcccgaccaccgggaacagcatgtagatgccgggcccgaggagcccgatgacgaggaacgtgcgcaccagatggtggcgcgggaacgcaccctcggcggccacgttgcgcaactggtggaacgcgacgaccacggcggccaccgcgagctggatgtagacgtaggagagcaggtgcgtgccgaccgggccggtggcccggacgatccggcccaccacccacgacgggttgccgagtgcgtggtcggcggtcgccacgtaccggtcgaggaccatgggccgggtcttcgacgtgatgagcagccaggtgtcgccggtcttgcggccggccaccagcagcagggccagcccgacacctttgagccgcaggacgcggtcccggccggtgtgccgcgtcagggcgatgaccgcgtgggccgcgatcacccacagcgcgccgttgccgaaggcgggtttcgcgccggcgatccagcggaccagcaggaagacggcgtcgatgccgacggccgcggcgaccgagacgagtctctcccggcgggtgagcacgaccagggtcagggccagactggcgtacagcaggaagcccgacttgggggcgaacaggaactctttcacctggttggtgaccggccccggcaggccgcaacggcgggcggcgatttccagcgcggccagaaaccccaggcccacgatgcccgtgacggcccacagcaccacgcggggccggcgccacgcggggaacgcttcccgatcacctgtccgggaaatgtcccgcactgccatagttttcacggtttaccggctgccattttcccgttgttgggtaccttgtcgtcgagatttccccgggagccgcctgcggtcccgggccatcgccacgaggtcggtcatcctagcggagtccggcacgggcgacgggcccactgagcggcgaccggcccgactgactaacgtcaacgccgtggtgagcgtcgagggcctgagcgcccggcaggaaaagttcgcgatctggcccggccggatcgtcaccctggccggcatctgggtgctgctcagcttcccgctgcggatgttctcctggacctggaccgtcgactacgcgttcagcctgctcaacgtcccggccgagccgaacctgttcatcgccgccgcgctgctgctgctgggcagcgcgctgcgccgccggctgcgggccgcgttcatcctgctgctgatctaccagatctgcgccaccgtgctggacacgatcaccgcgctggtcggcctcgcctactgggatcagcccgagcaggccgacctggacctgtcccgcaccgagatcgtgctgaccgccgtggccgtgccgatcggcctggtggtgacggtgctggtctggcgggcccggcgcgccttcccggcccggctggcgcacgcctcccggcgcaccgcgctgatcctgctggtcgccggcctcgccgccgcctggagtctggccttcagcctgacctggttgttccccgactcgctgcacggcatgggcgagcgggtgatctgggccaaccgctcggcgctcggcctcagcgccgccggcgacaacgccggcctgcacgggcatcacgggcaccactgggtgtcggtggccgcgtcgacggtgtccgcgctggtgctgctcggcacggtcgccgtcttcctgcgctcggcccgctcccagcagtatctgaccgcggaagccgagctccagctgcgccggctgatcctggagagcggggatcgggactcgctgggctacttcgccacccgccgggacaaatcagtgatcttctccccggacgggcgggccgcggtcacctaccgggtggtcgccgcggtcagcctggccagcgccgacccgatcgggcacgtcggctcgtggccggccgcgatcggggcgtggcgggccgaggcgcaccggcacggctggttcacggcggcgctctcggcgagcgaggcgggggccaacgcgtacgtcgagtcgggtttgaaggcgttgagcatcggcgacgaggcgatcctcgaggtgagcggcttcgacctgcagagccgggcgatgcgcccggtgcggcgggcggtcacccgggtgcgcgccgccggctacaccgggcaggtccgccgccaggcggcgatcggcgccgacgagctcgccgagctggaccggctggccgcggcgtggcgcggcgacggctccgagcgcggcttctcgatggcgctcggccggttcggcgacccggcggacggccgctgcgtggtggtcaccgcccacgacccacagggccgggtccgcggggtgctcacgttcgcgccgtggggggtgcgcggcctgtcgctcgacctgatgcgcgccgaccggcaggccgagaacgggctcaccgagttcatggtggcggtcctcgtcgaagcgtgcccggacctgggcgtacgccggatctcgctgaacttcgccatgttccgctcggtgttcagctcggccgacatggtcggcgccggtccggtcacccggctgtcggacgcggtgctgtcggtcgcttcccggttctggcagctggagtcgctgtaccgggccaacgccaaatacctgccgaactggctgccccggttcctctgcttcgactcgtcgctcaccctgagccgggcggtgctcgccgccggcattgccgaggggttcctgccctcgctctcccccgccgccacggccctggacgccgacccggccttcctgcagcagatccgcgaccaggaggaccagttgctgcgcccggccgtcccgctgcgccggctcagccagcagcagcgcgcccgcctggacaagcgggcccgcctggccgaggcgtacccggtcacggtcccgcgcaccgtgacgctcgccgaggcccgcacgctgccggccggcaccggggtgtcggtgaccggccgggtccgcgccctgcgtgacctcggcggcgtgctcttcgccgtgctgcaggagggtgacgccacgctgcaggcgatgctcaccgccgaccgcaccccggaccaggagcgcctgcggtggcggcggaccgtcgacctcggcgaccacgtcagcgtcaccggcgcgatcggcagctcccgcagcggcgaactctccgtcctggccgacacgtgggtgatggccgcgaaatgcctgcgcccgctgcccgacgtgcacgccggcttcaccgacccggaggcccggctcggccagcgatacctcgacctgctggtcaacccggacgcgatgcaggtgctgcggcaccgcagcgccgcggtccgggcgttgcgccaggctttcgccgtacgcggtttcaccgaggtggagacgccgatgctgcaggccgtgcacggcggcgcgtcggcccgtccgttccggacccacatcaacgcgtacgacatggaactctatctgcggatcgcccccgagctgtacctcaaacgcctgtgcgtggccggcatggagaaggtcttcgagctcaaccgcaacttccgcaacgagggcgcggacgccacgcacaacccggagttcacgtcgttggaggcctatcaggcgtatgcggactaccacacgatgcggcacctgacccgcgagctgatcctcgaagtcgccaccgccgtgcacggccggccggtggccctgcgcccggagggcccggtcgacctgggtgagccgtggccggtgctgaccgtccacgaggcggtcagcaaggcggccggcgccagcctgaccgccgacacgccggtcgacgaggtacgccaggtgtgcgcccggcacggcgtccacgcgaaagccgacgcgacggcgggtgagctggtcgtcgagctctacgatgcgctcgtcgagaagcagacgacgtacccgaccttctacaccgacttcccgctggagacctcaccgctgacccgcacccaccgcggggatccgcggctggccgaacgctgggatctggtggccttcggcatggagctgggcacggcgtactccgagctggtcgacccgatcgaccagcgggaccggctcaccgcccagtccctgaaggcggcggccggcgacccggaggcgatgcagatcgacgagtcgttcctgaccgccctggagtacgcgatgcccccgaccggcggcctcgggctgggcgtcgaccggctggtcatgctcctcaccggcaccgccatccgggccaccctcgccttcccgttccatcgccaggcccggccgtgaccgcccggccgtgaccgcccggccgtgaccgcccggccgtgaccgcccggccgtgaccgcccggccgtgaccggccgcgccggggatcaggagcgccgcgcgacgtccggcgtctccgcgtagtcgggcaggtcgatgccgttgatggcgcgggcggccaggtcggcgaaccagtcgccggtgaagtccgggagtgcggtggtgtccgggccgggaaggtcgcggctgcgcgcattcagccggccgatctcctggttggcctcgacgaacggccgcatccgggtctcgtagcgggcgaacccggtggccgggtcccagccggccgcggccagctcaccggccagcacgtaggcgccgaccagggccagcccggtgccctgcccggacatcggcgaggagctgaacgccgcgtcgccgagcagcccgacccggccgtgggaccagctgtccatcaccacctgggcgacctggtcgaggtagaagtccggagtgtcgtccagatgcgcgagcattgccggggtgtgccagcccaggccggtcatccgctcgcgcagcaggctcttctgggcggcgacgtcccggtggtcgaccgcgaagtcggcggccgggaaggagaacagcgccatcgcccgggtggcgtcctggatggggcgcagcagggccgagcgcccggactcccggtcctgatactccagcagccagcggtccaggccgaactcgttgggcacactgtagaaggccagcacgtgcccgaggtggcgcaggaaccgctggtgcggcccgaaaaccgtcgcgcgcagcgacgagtgcagcccgtcggcgccgacgaccaggtcgaaacgccgccggtcaccgcccgcgaagaccacgtcgacgccgtcggcgtcctgggtgagctcggcgatccggtcaccgaagacgtagtcgacgccgtcgcgggtgtcgtcgtagagcacccgggacaggtctccgcgcaggatctcgatgtccgcgatgaacccgtcgccgccgtcgtcgtcggcgcggaaggtcgccagcacctgcccgtccgcgtccacggtgtgcgcgccggcggtgtcggtgcacgccgcgcgcaccgccgcggccagccccatccgcgcgatgacgtcccgggccaccccgcgcgcgtccaccgcctgcccgccgggccgcagcccgggggcccgctccacgacggtcacctcggctccccgccggtgcagccagtgggccagggccggccccgcgatgctcgcccccgtcaccagcactctggcgccgctcatcgttgccctcctgttttggctctgttccggtggggaatgtccgctgccatgcagccatctgaacagtacgcaaccgtgccgcccaccgagaccgcgccgatcgcccgggccgccaccggcatgctggtggtcgacgccgccggggacgaggtcggcaaggtgagcgcggtgcagccgccgggcacgccggtccggccggacacggtggccggggtcgccgaggcgctgatgggctccgggtatctgcggatcgacgggaccggggcactgtccaacgacacgtacgcgggcggcgaccagatcgtcgccctcgaggacggggtggtgcggctgcgggtggggcgcgacgggctgcaccgggccgcgagctgaccggagtcgatgtcctgccgttgcgggaggatgtcggtggtggaccgggacagccacgcggtccacgcgacggtccggacggcgccctcaccacgttcagcgaaagcacagggccctcccagcgggagggacccggttctgcgatcatttccggcatgacgggacgcgtactcagcaaatcggaccttgtggtgctgggcgccggcgtggtcgccgtcgccgccgccggggttctgcactacagcggtgccacggcggtactggcgttcgtggtcgccggcgtcgccgtggcgctgctcgcctcgctggtcgggcgcagtgtggagcagctcggcgaccggttcgggccgggcgcgaccggggtgctgcaaagcgcgctgggcaacctgccggagctgttcatcggcttcttcgccctgcaggccgggctgctcgcggtggtccaggcggcgatcatcgggtcgatcctgtcgaacatcctgctggtgctcggcctggcgttcgtggtcggcggggtcaagcacgggacgcagcggttcgactcggaccgggcccgcacctcgaccgtgctgatggtgctggccaccgccgccctggtgatgcccagcctggcgcagtacgtgcacgcgccggccgccgggcacgagaaggcactgtcgctggtcgtctcggtcgtgctgctgggcgtgttcctgctctcgctgccgtcggcgctcaagcgcagcccggtggccgagccgtccgcgccgcaaccggccgagcacgcgggcccgcactggccgctgtggctggcgctgaccatgctcaccgggtcgagcgtcgccgccgcgctggtctccgactggttcgtcgccgcgctggaaccggcgatcacctcgctgggtgtctcgcaggcgttcgccggcctggtcatcgtggcgatcgccggcaacgcgatcgagaacgtgatcggcatccagctggcctaccgcaaccaggccgacttcgcgatggccgtgatcatccagagcccgctgcaggtggcgttggtgctggccccggcactggtgctgctgagcctgttcaccgcgacgacgctgaccctggtcttcgccccgctgctggtgatggcggtcgcggtggccgtgctcgcgaccgccttcatcgtcttcgacggggagtcgaactggctggaaggcgccaccctgatcgccctctacgcgatcatcgcgaccaccttctggtggggctaggagccctgcttggccgcccactcggcgacccggcgggcgctctcctgctcggacaggtcctcgaccctcgtcatgatcgaccagcggacgccgtacgggtcgcgaatgctggcgaaccggtcgccggagacgaacgtggccggcgcctcccggatggtcgccccggccgcctcggcccgggcgaccacggcgtccacgtccgggcagtaccgcccgatcgagtaacagtcccggtccccctcgggcggcgggatcaggccgtagtccggtgacggctcgccgagttgcagcaggccgtcaccgaagtcgagcacggcgtgcgccaccgtcccgccgaactcggtcacgtcgaccacccgcgctccgaagatcttgacgtagaagtcgatcgcgccgcgggcgtccgggatgaccaggaacggggtcaggccggtcgcgccgtgcggagtgccgttcgtcgtgtactgcccgtcggcggcagagtgtgtctcggtcatggtccagaatcgtaggaatgaccggcggcgacccgcttgaagattcgcgacaggatccgcacccgcggggtgtcctctacccggcgcggctgccgaccttcacccggctgcccgcgcccggaccggtggcgcacctggtgcgctggttctggatcccggagtggcggatccagccgggacgctcgtcccgccagcagctgatcgccttcccggcctgcaacctggtggtcgagaaggaccgggtcggcctgtccgggccgaccacgcgcgcctcacaccgggatctgatcggcaccggctgggcggtcggggcactgctgcggccggccgcggtgccgcacctggtcgccgacccggcggcgctgcgggacacgtaccggatgatcgatcttcccgatctgcacgagggggtgtcccgcgcgatggccggcgacgggccggagcggcaccgggacgcggtcgacgccttcaccgcctggctggccgcccgcatcccaccgccggacgcggaggcgctgctggccaacacgatggccggcctcatcgacgccgacccggcgatccgcacggtccaggacgcgacggcccggctgaacatctcggcccgctcactgcagcgactcgcggcccggtacgtcgggctgcccccgctcgcgatgatccgccggcgacggctgcaggaggcggccgagcggctgcgggccgagccgggcacgaacctggcggcggtcgccgccgacctgggctacagcgaccacgcacatctggccaacgagttccggtcggtgctcggcctgaccctcagcgactaccgccaggacttctcgtgaccgcattgtcgcgagcgaggtccacggcgggcaccgcacccgcaccgggcacgccggagcggtcagccgtggtgtacccggcctcgccccgcgttcttggcggcgtacatcgcggtgtcggcacgacgcagctgcgcgttcgggttgtcaccccgggcggcggtgatgacgccgatgctggcgccgatgtacaccgcgcgtccggagatctcgaacggctgcgccaggtcctcgacgatgcgctgcgcgatggtcccggcggtggcgtcgtcggtccagggcaggatgatcgcgaactcgtcgccgccgaggcgggcgaccacgtcggcggcgcggaccacgccgcggaggcggtcggcgaccccgagcaggatgctgtcgccggcgtcgtggcccagcttgtcgttgaccggtttgaacccgtcgaggtcgatgtagagcagcgcggtggggccgacctcgccggtcagcgactgctgccagcaggtgtggaaacgccggcggttggccaggccggtcagctggtcggtggtggcctgcacctcggtcgatcgcaggctttcggccagcaggaccaccaggccgtgcagacgcgcgatgaccagcaggaacaggaccacacagccggacacgatgaccgggatgtcgatctcgccgccgcggaaccactcgatgatcagtgccgccggcgccatgaggctggccagggccagcgcgatcagccgtcccaccccgatggtgccctccgccgtgggcggcgacagccgtgacatgtcggccatcgtcgggtgcagggcggccgcgccggcgaaggcgtacatcagcatccacgccccgtcgatcgggtccccggcgtggtagccgatggtgagctccatcagcccgtagacgacgtcgccgacgagcatggcggcgccggccgccacgaagagccggaacgccggctgccggtccccgcggccggtggtcagccgcagcaacacggccagaagcagcagatcagcggacggataggcgagcgagacgacccggcccaggacgtcgagatcggtggcgtgaacgtagggttccatcaggaacacccacgacagcatggccgcaccggtcgacagcaccagcgcatccagcaggccgggccggtcccgacccggtcggcgggcccggacgagaccgagcaggcccaccgtgagcatcgggtaggagcccaggtagaagacatccgcgacggacgggaagacgtcgcggcccaggaccgaactctgcacccagtagatgacgtcaccggcggcgaagaagagccaaccggccgccatcacgtaccacggccagcgcgtcgccggccggtgacgtgccacgccgaccgcggtggcgaccaccgccgagacacccagtagcccggtcaggaccgttttgaccgactcccacggcaccaggaagcacgccgccatcaccactacgcagaacgcgagatataccgaccatgcctgacggccgaaccgcaacaccatgactcctcgaaccggatgaccctggcagtcgcatcgggaacagacctccgggcatgaggtttcgagacggtgacatccccctcccgccgtcgacggcgaggcgcaccgggaccggtgaccgggggtaggcccgtcctcgaggtgaccttgcagcacgtatgatcatgaatgcgtgtatcgtgctcggtcgatatcgaccgagatcatggggggtcacgcatgtccctacgtgcacgcctgctgcgggcttccgcggcactgacactcaccgtttccgcggccctggtcgccgggagtccggcgctggccgccgcggcacccaccaccctgccggccggccagttcaccctgaccgccgactacagccggttcgatgcgctggacgccgcgctggtctcgaagctcggcaccgcctcggtctcggccgtgatggccgacgcgaaccacgaccggcgggggatcaccgatgcgctgaacctggccgggtacagcaccggcttccagttcgacgacaccgacgtcaacgactgcgcgaacttcccgcagggcatcaccagcagccgggacgccatcggcaccgcgaacagcggcaactatgacggacaccagctgatcctggtcagctggtacaccgaggacggttgcggcggcagcaccgcacgcagccggatcaccctggtcgactgggatgcgacgtacccgaacagatatcgcaagatcctcttggtggagccgaccggcacggcggccgcgcccagcttcaaggacgtgctggtgcacgccggcggcgtcgcctggtacggcgactacctctacgtcgccgacaccgggcacggcatgcgggtgttcaacatgaagaagatcctgaagaccgacaccgggggcaccgccgaccagatcggacggcaggacgacaccacctattacgcccacaattacgcgtacgcgctgccccagctcggcacgatcaccgcggccaccacctccggcacggcactggcctggtcgacgatctcgctggaccgcgccgacccgtcgatcgtgatgaccgagtacacctgctcgtcgggctgcaccgcgtacccgaaccgggcggcccgcgcgatccgcttcccgttcgccccgggcgccaccaccttcgcggccagcaccaccgcgaccgaggcgctgaagctgccctggttcaagctgaacggcgtcgcctcgcacaacgaccgctggtggttcaactcctccggcgacaagaagttgtactactggacgccggccgccggcccgtccgcgtacgcctgggtcagcggcggcgagagcatcagctactgggaggacaccaccaaagccgacctgctgtggtcgctgcaggagccggtcgggcaccgcaacgtcttcgcggtcgaacagggcagctacgacggctgatccacccggggccggccggcacgccgccggccggccctactccgagcggcggaccttgcgcatcagcatcgcccacaccccgtagccggcaccgacgtcgccggtgaccgcgcctgcggccgaacccagaaacagcgccttcgcgcagtccgggcagacctcgcgaccggtcacggtctgctcgaacggctcgcgcacactgcgcccgcagtccgggcattcccgccctgaaagtcccatcgcctgatctcctcaccgccgggcgcccgagtgtacggccctcaggacaagccggcccggcgccgctgcaggtgggcggtctcggcacggttggtcgacaggacgatggcccggtcgtacgccgttctggcctgatcgtgctgccccgaccggcgcagcagctcggcccgggtcgcgtggaacgcgtggtagccgtccagcggcaggtcgtcgatcagtgccagcgccacccgcggcccgtcccgctcggcgaccgcgatcgcccggttgagccgcacgaccggcgacgggtcgagccgcaggagctggtcgtagagggcgaccacctgcccccaggcggtgtccccggcgtgccgggcatcggtgtgcaccgcgttgatcgcggccaggatctggtagcggccgggcgcctgcccgccggcgagccgggcccggaccagcgcgtgcccctcggcgatcagctcccggtcccagagggcgcggtcctggtcggtgagggtgaccaggtcgccggtcgcggacacccgggcggggcgccgggcctcggtgagcagcatcagcgcgagcagcccgaccacctcaccgtcgtccgggagcagggcgcggaccagccgggtcagccggatcgcctccgcggtcacgtcggcgcggaccggctcgcgggcgggatccgacgccagatacccctcgttgaagatcaggaacaggacggccaggaccccgccgacccggatcgggagatcttcgcggaacggtacgccgtacgggatccgggcgtccttgatcttggctttggcccgggtgatccggcggctcatggccgcctcctcgaccaggaaggcgcgggcgatctcgggcacggtcagcccgccgaccatccgcagcgtcagcgccacccgcgcgtccatggcgagcgccggatggcagcaggtgaacaccagtcgcagccggtcgtcgtcgacggcgccgagcgggccgggcgggtcgtacgtcatcagcgcctcccgatggatctcgtcgcgccgcacctcacgccgcagccggtcgatcgccttgcgctgcgcggtcgtggtcagccaggcacccggattcggcggtacgccgtcggccggccaccgttgcaccgcgatcgcgaacgcctcggcggccatctcctcggccacgtcgagatcaccgatccgccgcgccagggtcgcgaccacccgggcccactcggcccggtgcacccgggtgatcacctcgtcgatcgcggtcatgcgcccaggaacgggcgcagctcgaccctccggttgcaggccttcgacccggccgcggccagccgcaacgcctcgtcgaggtgcgccgcctcgacgatccagaagcccacgatgtgctccttcgactccaggtacggcccgtcggtgaacaccggctgcccgtcccgcgcgtcgacgacggtcgcactgcccggcgccgccagtcccccggcgaacacccagtgcccgtcggcccgcatcttcgcgttgaagacgtcgatcgccgccgcctccgcctcggtcgcccgcgtgtcggcgtcgttcagcacggacatcagatactgcgtcatcgcgatgctcccgatcccggtggccgccggcggcggccgctccaccctgctacgaacggacccgccccgatccgacagccccctgatcagaaggtggcgcggacgtcggcgcgcagccggtggacgccggcctcgaccttgaccagctcgtcgagcatcgcggtggcggcctgctcggcggccggggccggggtgaagacgccgtcggtgaggtgctgggcgtggaacgggatgttcacgctctcgaccaccgggatcatccgcagcgtggtgaccacctgcttgagctgctgcacggcgcgggtgccggccgcgatcccgccgtaggagacgaagccgaccggcgcgtacgcccactcctgggacaggtggtcgagcgcgttcttcaccccggccgggtagccgtagttgtactccggggtgacgaccacgaccgcgtcggcggccgcgacccgggcgctccagtcccaggtgtgctggtgcacgtactgccgcaggcgcgggtggtgcgggtcggccagcagcggcaggtcgatctcggccaggtcggcgatctgcacgtcgaagccgccgtgcttggcggccgcctcggcgaaccaccggccgatcggcagcccggcccggccgggacgggtcgaaccgatgatgatcatgagctggggcatggggatgcctttcgaagtccggagacgatcacgaccacccgcccattgtgcaccggttcgcgaccttcggcagcggcgtccccggcggcggtttcaggcggcggcgtcccgctcgcgcgggcgctgcgccaggtgccggacccactcgatcgccgaggtggccatcaccaccgccagctcggcccgggcgtgccggaccgacagcgcgtcctggcggggcaggccgggccggggtcgctgcgcctccagcaccgccaggcagcgggcgacgaccgcgtcgaaggtggcccgctcggtggcggccatcgccagcagcacccggtcgagcacgtccggcccggccgcgtccggcggcacgtcgagcagccagccgaactgccggcgcagacccgcgtcggtcagcgtgaacacccgcggcgaacgcggtggcagggcgcgggtgctgggccgcacgtaccccgatttctcctgccggctcagggtctgcgcaacccgcagcacgtcgacggcgcggtcggccccgaaggtctgctcgtggcgctgcttcaggtcgtaggccgagccgggccggtcggccaggaagacgagcaggatgtcgccgagtgtcgccgtcatgacgggccgcccctcccgggtcacgccagcttttacaacagtgtagaagctaacaggtgaccatcccgcacctgccgtccctcgcggcggcctcggcggccgccttcctgctcgcctggctgtccgcggtggccggcttcggcggcggggtgctgctgctgccggtgttcaccgcgctgttcggcctgcgggtggcggtgccgatgctgaccctcacccaggtgtccagcaacgccttccgggtcctgctcaaccgtcgcgacctgcactggcggctggtcgcctggttcaccgcgggtgccgccccgtgcgcggtcgtcggcggcctgctgctggcccacgccccgctgggcgcgctgaaacgggtgctcggcgtcttcctgatcggcgtggtcgtctggcgccggctgcgcccacaccccggccggccggccgacccggcgttcgccgcggtcggcgccgcctccgggctgggttcggcgctgctcggctcggtcggcccgctgaccgcgccgttcttcctcgcctacggcctggcccgggccgcctacatcggcaccgaggcagccagcgccctcgccatgcacctgtccaagatcgccggctacggcgccggcgacctgctgaccggacaggttctgtggtacggggtggcgctgaccccggccaccctggccggggcatgggccgggcgccgggtggtcggccggatcagcgaccgggtcttcgtcaccctggtcgagctcggcctgatcgccgcggggctgctgttcatcctcggctggtgaaccggccggacgctggtcgccctcccctcacctgcgcctggtgcgctggcggcgatgacgatcccgccgaggcgcgccggcgacctcctcaccgcgtgggtggaccggctgccaccccggctgcgccgccacctcccccgcgagctggccggtttcgccatcctcggctggttcaccttcaccgtcgacctgaccctgctcaccgtgctgcgccggcacacgtcgctgccgctgccggtcgccgtgtccatcgcgtacctgaccgctctcaccctgaacttcacgctgaaccgcacgatcaccttccggtcgcacgcgccggccggcccgcaggtcctgcggtacatcgtggtcatggtcggcgactacctgctcaccgtcggcgtctcgaccggcctgacgatgctgggcgcgccgttcgcggtcgcccgcgtcgcggcgtccttcctggtcgcgatcctcacctacgccgcttctcgctggtgggtgttccgcgatcgccgcacctagcctagtaggacagcagaacttccgtgaggcggcgtctccgctggcagcggcttgttgtggccccgtgctggtgccgacggcgccatcgtgaccatcgatcgatgaggtcgcgatggcggcgggtggtgatcaggtatgccagcagacggcgggtccgtcgagattgagggcgatgaggccgccctcgggcggtcgtcttttcccgccctggcggcggcgacggcacgaaacgcgtgggcgagcatggccagggtgatgtaggcgtcgtagcggcgaacctggtgctcgtcgaggccaacttggccttcgcggttcgaaagcattcctcgatcgcccagccacttcccgcgactttgatgaggacacggctgaagttgatctcgcacgggtgaccaacggagttttctgaccgttcggcggatccttggggcggccattcggtcactggtggcatcgccgaaagggattactccggcgcggccggttcctattgtgatttcattttcttacgtcatccgaatggcgtaagggcatccgaattctcgcccggattatcggcccgtgatccgatctgtcggcggcgtcatgccgccgaaagaactgatgtatccatcggagggaaaatgaaaagaattgctcgtgtgctcgctatgagtggtccgggcctgggtgccgctctggtgatcgctgcggggcctgcgcaggctgccaccgtcacggcccagccggccgtgcacagcgcgtcggtccaggccgcgggccattgggacgacagtgatgtcgtcgggtacttccggacccggttcgggtgtgagcgggtcggccggctcggcgagtaccacggccgttgggatgactacgactgctcgcgggtgtggtccgggttcaaccgcggcgcctgggtcctggaggtcgccgccgacgactggaacggcgactgggacgacgacaactggtaccacggctggtacgacagctatcacggtggggacttcgacggcggctgggatcacggtggctggcaccatgatgacggcggttgggacggccaccacccggacggttccggtagcgtagccgtgttcccgctccactcccgggcccgatcagtgaactgacctgaggcaccggttgcgggtcatgcctgtgctggcgtggcccgcaaccgtatacacccggctgcgcaggcgaacgcggcgccagccgattacgtcggcatcgaggtcatccgtgtgaacgaggtgctgttgcgggctgcggagtctgatcggccgagtcggtgcgttgcgacggcacgtctaccgcagctggggcaggcgccggcaggcggtcttcgtgccgttgtccggattttgagcccgcggacagcaattccttgatggctgctttcgggatttccttggtgatgtccccggcatggtgcggtccaggggccggcagcggttgccgaccgacgggggtggtcgctgccttccgggtcagtcgcggcccggcttgccacagggtgaggggaagtaggcatacagccagggaggtgcacggccatagcagcgacgccgggctcgcgtagccgcgtacataggaaacggctacagcggcggtcaggacggcgagccagccaaggtggttgcggaaggtgcgcaggccgtcgttactggtgctggttcctttcggggtgaccacgaatttggccggtcgccgcagcagggtgctgcacagctgcccggcgtacaggggtgcggcgatgacggacatgagcatgccggtcaagccccacgagttgggtggctcgtaggggctgacgttgtagcgccggttgtggatgtacagccacagtgagaacacggtggcgtcggtgtagagggcgagccaggtgcgggcgacgatggtcatgccggtgacaccgaggccgaggaacagcaccgagttcaggatgcccagcaaccagccgatcgccatcgacgggtagaacgtggtgatcagcatgtagtgcagcatcgcaccgggcgacagtcgcaggaagcgccgccagaaggtgccggagaggatctcgaaggtgccgcgcgaccagcggcgttgctggctgaaatagtcgctccagcttgacgggccctcaccggccgacagcacgtccggggtgtacaccgatttccagcggttgccggtggcccggttgcgactggtgtggaacgccagaccggtggccatgtcctcggtgatcgagtcggccagacctccgatgcctcggatcgcggcgatccggatggcgttgttcgtgccgaccagcatcggcgtgccgtaacggttggcggcacgctggatgacgctgtggaacgggaactgctgcgactcggcggcgcgggtgacgaactcctcgccgttcttgtagcactgcggcccgaccgcataggccacgtcggggtcccggaagtagcccaggattcgttcggcgaagttggccaagggcacgtgatccgggtcgaccgacagcagcacgtcgtaccggtcgccgtgggcgtcgagccaagcgttgtagttgccgtgtttggtcctggccttgaacgccccggccggctggttgtaaccggtattgcccttccgggtgaagtgccgcacgcccagctcggcgcagaccgctttgacggccgggtcatcgccctcgtcgagcagccagacgtcgaaggtcccgcggtgccggatccgggtagccgcacgcaacgtgtccgtgacgaccgcgatgggctccttgctcggcacgatggtggtcagaaaggccacccggaggtcgtcgtcgggtacgacggggaccgggtcgcgggccacgaccgaggccagcgacagcgacagtacgttgatcaggcgaagcagctcgacgacggcgatcgccgcgatcacgacgaggttcgcgacccgggcggcctgggccgcagggccgatgtgagtcggcccgatgtggtccggccgtagcagccaggcgaaaaagaacacttcgaagcacacgttgcagagcgcgatcaccgcagcgttaatcatgtggcgccggccgtcgaccgctcgctggttgcgataggccacccggtacggacggtcgtccgggacgacggtgagcggaccggcgagacggctgaaagcttccagccgcgcccaggacgcatcgacggcaggcggctcaggggttgagggcaccaggatcctttcgctgtccgagacgcccggccaggcgcatgccttacggcggtcgatgccagggcgtttccgcgggtgcgggatcggcgttcagcacggcgagcgtaggagcaacggctagtcagcgcatcttccaccggcacggtttgtacggcttcgtcccttttattcggttaaaaatcacccacttcggggggttccgatagcatttattccgtcttccactgttgaaagggcttgccttctcgtgttgattcccacccgacgccggcgattcacgctcgccttgatcgctatcagcgcgatcgcgatggccttgtgttgtgtcaaggaattcgccaccgacggacaccggcgcgcaccgaagccgagcacagcgcggcctggcgctgcaacttcgatgcttcgggagaacagtgcgctggcacagcagcatttctatgtggatccgcacgggcgcgcagcgactcaagccgcccagtggcaggccgacggacactcgcagcaggccgccctgctacgcaagatcgcggatcggccggtagcagactgggttaccgacggaccgatacccgtggccgaacgggtgggcgcactcgtgggtcgggccgaggccgccgggcagctgcccgtgctggtggcctacaacatccccgaccgtgactgcggcggtcacagctccggcggcgccgcctccgccgcccgttacggcgagtggattcgcggattcgcccggggcatcggcaaccgacccgcggtggtgatcctcgagccggacgcgatcgcgcactcgctgcagggttgcgccgaatccggcgagcgactcgccgtgctgcacgacgcggtcaccgtcctcaagggcaacagctccaccagcgtctacctcgacgccggcaacccgggctggatcaccgacacgcgtcagctggcactggcgctgcggcgggcgggaatcgccgaggcggacggtttcgcgctcaacgtggcgaacttctacaccacctccgacaacatcaccttcggcaacggcctgtccgacgcgctgggcggccacatccacttcgtcgtcgacaccagccgcaacggagacgggccggcgccgagcgacgatacctcccgctggtgcaacccgccgggccgcgcgctgggtgcggcaccgaccacagagaccggtcaacccctggtcgacgcctttctgtgggtcaaacgtcccggtgaatccgacggctcctgccgttccggcgagccgcctgccgggcagtggtggccggagtacgccctcggcctcgcggctcgcgcttcctgaccggcatgagagcgggcaccccttccggatccggcggagcgcccgctcgatgcaggtcaatgcacggtgatccaccgagctaccgacggaacgccggctcggttgaccacgaacgccatgtaaggtcccggaggcatgagcgcggcctgctccggcaccgtgacgcgcacgccggcggctgtcgtcgtgaagggcaccgccaaggaccgctggtccggattcagcatgtgcgtcgcggcgctgggccggatcagccggacactggcgatctccgccggcgagcttgtggcgaagtcggctttctgcccgtagccgacgacgggcggcccagcagtgatctggggccgcggcccgtggaacaggtacggcggcgtgtagatctccagccgctgctcgaacgttccggaaatggtgttcttcttgtcggcgtacaacggatcggaaccggccgtcagcacccgcccgtcgggcagcaacaccgccgagctgtgatagttacgcccgatgtgcgggtccgccgccatcgacaaggtattggtgtccggatggtagatccgcgcgacatggttgtcgctcgccccgcggccgcgatagtcgcgcgaaccgttggtgatcaacgtggtgtcgtccggcaggttcaccaggctcggatagcgagtaggctccggcagatccggcccgggccggaagtgcggcgtcggatcgttgaggttgatgatgtcgatacgccgggtcgagtggcgagattcgccgacgcctccgccaccgaccaccatcaccgtctggttctgcaccggccccacccacgccgacatgctggtttccagctggtcaggatcgcgtaggccggagacgttgcggaagctgttgtcactcaggttccacaggcccgggtcacggccgcggtcggccggcccgtaccccgaattggagcccgtgtagaacagcacgccgggctttgccgtctgcagcaatgtcgggtaggtcgggaagtaatgattgaggtccttgcggaccgtccacgtctgcgtcttcgggtcgaagacctcgttccgggtcccatcgacgaccttgccgctgccgtccaggccggacaacgccaagactgagccgtccgacaagcccgtgagcgtcggataccagcgcttctcgtgcatatcggcgacccgctcgtaccgctcggtcaccgggttgaactcgtaagcctccttgcggccctgatagtcctgcttatccatgctgatccggtcggtcatgccgtacacgttgcgcgcatcggctccggtgagcccgtcgatgcggtattgaccgcggatgccggtggcatactggacgccgtcaccggctccgtcgacccacacgtcgacggagctcgccgcaacggcgaccttcgtcttaccgccggccgccgccggcgtcaccgtcttggtggcggcgggaaccgtgaaggcatcaccggaggtgtagcgcagcccgttcgccgccacgaacacggtgcccttcggaaaggaacgggcgccgtcaggtgactcgttcttcaccgtcatcgttccgcccgcatgggtcacgtccggctgcagcacctcgtagcgcagcgtgccgccggcgaccagaagcttgccatttggcagaaacgcatgacccgcacaaaacaaatcggtcggggtaggtaccagcttcgtgtttccgctgaccggatcgaacaccagtgtcttgaacgtgcccgccttgaattgggtgcggtcgttgcccgaacccgcgatcaacagcagcttgccggacggcagcatcgccgagtggatggcgttcacccggctgcccgccggtagtttcaccacctgccagaaaccatgcgagctcttgtacgccgcgctattgatcaacttttcgtgctgccaccgcgacaccgccgaccacaccggcggcacattcaccgctcccacgaccgctgccgccgcaacgggccacaccaccttgcggacaacggtacgcgccaagaaaccagacaaaggaagccctccgagtcgatgaccgaccgacggtagaagggcgcgaccatccggatcaatcacccaatcaggggccagggggtcggcaaaattacattcgctcgaagcttcgtatgccggccgcactatttgtccgtcgcctatttcagatccgtaaaagactgtcgtcgtcggcttcgcccgacgccgaggcgagcgacggcgcaatagccgtccggctacggaaaataatcgtacggttgcgaaacgtttttgcgtagctacggacagcctttccgtcacgaagatggcgtcctcgggatttcgcccccggaagcgcctgatcgtacggcactctttccgcagtcgcagccaccgcagcccacagccgtgacagctccaccgatgaggtacaggcgccagcaggagtcgggacggtcgatgcggcgctgccttcagccggggtcggtggtcagtgtgtcgagaacacctgcgacggtcaggacgcgccgaacgtggccggcggcgtgagtgacagtgaactggcggttgccggcggtcgcggtattacgagcgacgatcagggtggtgatcaccgtggaatcgaggaaggtcaccgcggacaggtcgacacgcaccgtgatgatgccatcaacggcgagttgaccggcgaacaggtcgttcagggtggcggtcgcggcgaggtcgagttctccactgagggcgatggtgctggtggcggtgtcgcgttggacgctgtgctgccaggtggggttcatgccggtgtgctcccgccgtcgctgccaagaagcggcggaccaggcatgacggccagctccgactgctgtcgtgcgggcaccgtaccggagtctgcggccggtgtcacaccggccggcataccaggagtagtcaggcagatggtgatcgtgacggtcacgccatcgggtcgatcggtgatgagcagggtgtcgctgagctgggtggccagccagagcccgcggccaccgggcacgccggccggtggcgggctgacgatcggggggacgccgccggggaatccgctgccgtggtcgctgatctcacaggtcacggtgttgtcgtaccgacgcagcagcagccgaccccgaccgccgccgtgccgcacggcgttggtaatcagctcctgcacagccacgatgaagtcgtccaaccgttccccgtgcagcccggcgccggctgccgcggttcgaaccgtgtggcgcaggtcggtcagagccgccgcggcgaagcgggagtccagcgtcggcgccggtctgtcgaccggcctggcgagggcaggggccggcgtgcgcatgcctacacggtgcccgggtggcggtgccgcaaaacgcccactctcgtgccgcttgtcatcggtaccgtgaggtgatcgaagcgatcacgtggaagtaccgcaccgacaaaccagccgtccactaccaggccgcactcaccctcgcagggatcctgctctggaccaaaccatgatccgagagacgctttctggcgcgccgggtgcatgctgtaagcgggtggtgacgatgcgaatctattaccaggacgccgacatcacggtggccggcgcgggcgtcgaggtcaacggccatctctatccgttgggcgagatcgagaacgcctggcgccgcggccgccgctcggtcggccgccgcggccggatcgccctcgtcgtgctcctcgccgtcatcgtcttcgaagtcgtggtctgggcgctgacctggtggctgtgggcgttccgcggcctgctggtgatcgccgccctgctgctgatccgggtcgtcgcccacctggcggccggctccaccggcctgcaggccctggaggacctgcgccggtacggccgccgccaccagttgtggatcagcgtcgcccgcaccccgatctgcgtcctgtccaccaacgacgcgatccgctacggccaggtctgccgggccctgacccgggccctcaacgactacgacatcacgcccagccgctgacccggacgccgccggtcagttcagcaggcgctgcgcccagtagagctggccgtccgggccggcgctgaccagggcgatcagcacgtccgtcggattgcgggacgcgggcaggaccacctcgacggtgaccggagcggcgtccaccgaggcgacgtggacggcattgccccggctcacgtaaccgccgccggtcgcgacggtgccggcaccgcgcagccacggatagcgggcctgggcccggtcgaggaccggatcctcgccgaggaacaggtcaccgggccgggccgacgtcgccgcgaccatgtccggtttgacgtgcgccctcttgtccagcacgacgatccagaaactgttgcccgcccgcgggtgcgccggacgggtccaggtgacctcaccgaggaacgtgcggtcaccgtccccggcgacgatcgcccggcccggcccgaacgcggcggtgaccgccgcggcgtcggccgggtgcagggtggcccgggcgttcatcgccttcggcccgaacggcggacggtgatgccaccagcgccagccgacgaccgcggccacggccacgatcagggctgtgaccaggatcgccgctcgtttcacaccgggcagtagatcatgtgggcagatcccgcacctaccggcgtacccgcgcggccccaccgtgcccgccggcgtagggcggccggacgaaccaccggcgcggtgctcaccacccgccggacccggtgggacttcagcggcccgtggcgtacagggccgacacggcggccgcgtccagcgcgtacgggtagacccgcacgtcgctgatcgatccggggaagtagtcgccgtgggcgccggcccagaggccgcggccgaccgccagggagtggtcggcgcgccaggcgccggtgaccgccgccggggtgccggcgggtttgccgtcgacgtagagggtcgccgtaccggtggcccggtcgatcaccccggtcagcagctgccaggtgcccgctctgaccgggccgccgccggtgcccgcgaagaccggtgcggccgcgtcgtcggtggccggcacggtgatcgcccagcgtttcccggtgccgtcgtactgcaggtagaaggcgctcagggaggcaccgtcctggctgaccacggtccggttgccggccgggacggcggtcaggcgcgcccacgccgagatcgtgtagctgccccgggtgtcgacgacggcggaggcggtctcgcaggatgcgtccgcgccgtccagggtggccccgccgtccgcccaggtgacgccgttggtgcaggtgagagtctgcaggccggcgccgccggtgtcgggtgcggtgtcgccggcgccgtcggcgaggcgccagcgggcggccagggccggggtgggcggcggcgaccacgcctgggtggggtatcgggagcgggtgcaggcggccagcgtcagcggggccgggatcccggtgccggtggtcaggcaggtgccggtggacgcgttgcgcagcccgccgtcggattcggcgatccagcgctgggccgcggcgccggtgcaggtggccagctgcgcctggccggccgcggtcacgacgaggcacctaccgaaggcgcgcagggtgccgtcggtcgccgtggtccactgttgcgcggtggagccgttgcacgggtacgagtcgaccgccgtgccgtcggcggtgccggagtgccacacgtccaggcagtcggcggtggcctgccggccgcggatcggcccggtcgcggcggtcgccggggtgtcccgtggtgcggacacctcgacgtagtcgaccttcatccgggcgtacaccccggaggccggcgggtcgaccggcgggccgggccagccgccgccgacggccacgttgagcagcagccagaacggctggtcgaacggccaggtgcagccggccgcgacgacgtcggcccggaacgcgatcgagtagagcaacccgtccacccaggtggagatgtggtcggggtaccagtcggtggagaacacgtggtaaccgccggtcagggacgcgccggagggcagccgggattcgccgccgacgccgtaccagtcggcggtggtgctgccgtcgccgttgcggatcgtgcaggtgccggtggtgccgcgcggcccgatcggcccgccgtgggcgaccgtgccgttctcccccggcgcgccgtcgtccatcacgtcgatctcgccgttggccggccactgtccggtgtcgccctgcgcccagaacgccggccacaccccggcgccggccggcacctggatccgcgcggtgaaccggccgtaccgctggctgaacagggtgccggtgcgcagccgcgccgacgtgtacgcgcaggagccggcggcacagtcggcgcgggcgtcgatggtcaggtgcccggcgccgtccaggtaggcgttcgcccgggagtcggtgtaggtctcccgctcggccgcgtcgccgaactgcgggccggggccgacgtcgtacccccatcgcgtcggatcgacgacgtcgccggtgaagtcgtcacgccaggtcggcgcccagccggcggcgctgatcggggcggccgtggtgaggtcggtggcccgcgcggctccgaccggcaccacgagaacggccgcggtcgccagcacagcgacggccaggcgtcgcaacgtatcgatcacgctgagactatgccagcagctccggctcggtcttgctccggacctcgtcctcggtgacgccgggggcgagttcgaccagccgcagtccctcgggggtgacgtccaggacggcgaggtcggtgatgatccgctggacgacgccgcggccggtgtacggcagcgagcactccttgacgatcttgtaggagccgtccttggcgacgtgctccatcagcacgatcacccggcgggcgccgtggaccaggtccatcgcgccgcccatgcccttgaccattttgccggggatcatccagttggccaggtcgccggccgcggacacctgcatggcgccgaggatcgcggcgtcgatcttgccgccgcggatcatgccgaacgaggtggccgagtcgaagtacgacgcgcccgcgcgcacggtgacggtctccttgccggcgttgatcagatccgggtcgacgtcgtcgtcggccggataggcgccgactccgaggatcccgttctcggagtgcagaacaagttcgacatcatccggtacgtagttgggcaccagggtcggcagcccgatcccgagattgacgtacgacccgtcggtgagctcggcggccgcccgtgcggccatctgctcgcggctccagcccgtcacttcgctcctccggcccgcacggtgcgcttctcgatccgcttgtcggcggcctgctcggcggtgagcgcgaccacccggtgcacatagatgcccggcgtgtgaacctcgtccgggttcagctcgcccggctcgacgaggtgctcgacctcggcgatggtgatcttcccgcacatcgcggcgagcgggttgaagttgcgggccgcccggcggaacaccaggttgccgtgccggtcgcccttccacgcgcggaccaggccgaagtcggccacgatcgcctcctcgagcacgtgctcgcggccgccgaacacgcgggtctccttggccggggaggccacggcgacggcgccggtcgagtcgtagcgccagggcagtccgccgtcggcgacctgggtgccggcgccggtcgcggtgtagaacgccgggatgcccgagccgccggcccgcatccgctcggcgagcgtgccctgtggggtgagttcgacctccagctcgccggacaggtactgccgggcgaactccttgttctcccccacgtaggaggcgatgatccggcggatccggccccgcgcgagcagcagtccgagaccgaagtcgtccacgccggcgttgttggagaccacctcgaagtcaccggtgccggtcgccaccagcgcgttgatcagcactgacgggataccgcagagtccgaagccgcccaccgacagcgtggctccggccgggatgtcggccaccgcctcggcggccgagctcatcactttgtgcatgtcgcgatcctggctcccgccgcacgccgccgccaacgaaccgttcgttgatcgagattccggggtggggtaacgtccactcagtgaacgctcccccggatgtgctcggccgcgccggggtcctgctgcgcgccatctccagccacgagccggagggcgccaccacggccgagctggcccgcctgaccgcgatcgcccgtcccaccgcgcaccggctgctcaccgcgctgatgacggagggtttcaccgaccgtgacccgggcggccgctggcggctgggtccggagctgtatctgctgggcaccgccgccgcggcccgctacgacgtcaccgcggtggcccagcccagtgtccgccggctggcggtggccaccggcgaaagcgcgttcttctcggtccgccgcggcgccgagacggtctgcctgctccgcgaggacggcagcttcccgatccgctcgcacgtgctgcacgagggcatccgattccccctcggcgtcgcctcggccggcctggccgtcctggcctacctgccggccgccgaggtcgaccgctacctgtccgacaacgatctggtcccgggttacggcccggcccacactccggaccgcgtccgggagcggatctccaccacccggcgcgaggggtacgcggtgaatcccggcctgatcgtcgagggcagctggggcatggccgccgcggtgttcgaccgccgcgcccgcccgatcggcgccctcagcctgaccggcgtcgaacaccgcttcgccgcgcagcgccgccctcaactgggccgcctgctgctggaggaggcccaccgcctgtccgccagcgaccggctctgaccccggagttgcgccaggaccggccgcgccaccgcgaagacggttcgtcagtccggtggctccggcacctccggctccggatcgcgcggtggttcgggccgctcggattcgggcacgtcctgcaggtcgatcgggcgctcgaccggctcgggcggccgctcctcgggattcgtcatggagatcgcatacccgctgcccggtggcctacaccggcacgtgctcccggaggaaggcgaggatcccggcggcggcggacgggtagccggggtcgcccgggttcagatactgtccgtggccctcgcccctgaccacgacgaactgcttcggccacggtaccgcccggtaggccgcccggccggccccgatcggcaccaccggatcctgatcgccgtgcaggaacaggatcggcgcggccgggccgccgaacgcggtggccgggcgccggccggccacggacaccgcggcccgcagcgatgccggatgcccctcgacgaacaggcccagcgtggtcgtcgccccggcggagaacccgaccgcggccaccgcgccggggtcgaggtgcgcggccagcttcccggtggtcagcttcgccagcacgtacgcggcgtccgcggactggtgcccgatgtcaccggcgtcgacccgcacccggccgttggtgtgcgggtacgccggcgcggccaccacgtaccccgcctgcgcccactgggtggcgagcggcgtgaactgctccggcaggccgccgagaccgtggctgaacagcacgatcggatgccgcccggccgccgtgccggtgccgcgcgggccgctgagataccagaccgtggtcggcagcggccggtcctcgccccgggcgaagctcaacacctcgctgagcacccgcggaccgaccgggccggcggcccgcgcctgccggccggcgccacacccggcgagcagcgccggtaccagcgccagcagcaggacgaccccgatttttcgcacgccggaaccatagactcctcagtcccggccgcaagccgccgatggtccggttcatgcaggtggccccgacagatgacgcaacggctcggcacgatgcccggccggaggtggaccggctgctcgacaaggtccgtgcccagctgggtgtcgaggccgcctgggtctccgcgttcggcgccggcgagctgaccattctggccgcggccggcgccgccggggagatgcggctgccggtcggcgaggacgccggactgctcggctcactctgcctgcgggtgctggccggaacgctgccggagatcgtccacgacgtgcgccgtcacccgctcacccgggacctggacagcgccaccgacctggcgatcggctcgtacgccggggtgccgtggcggtccccggacggcgccgtggccggcatgctgtgctgcggcagccggcacccggatccgtcgctcgaccagcgggccgtccggtacctgtcgctgatcgccgagctgatcagcgaccatctgagcggtccgctggccgagcagcggcacagtgtggcgtccgcccgccgggccgtgcagggggtactggacagccgggcggtccggatggtcttccagccgatcgtccgcctgcacgacggccgggccgtcgggttcgaggcgctcgcccggttcgacccgggcaccttcgccgggccggaccgggcgttcgcggccgcctccctgtgcggtctcggcgtaccgctggaactcctggccctgcgccaggcgctgcggcggctccccgagctgccgggggacgcctggctggcggtgaacctgtcggccgacgcgctgctcgacgccgacgtgctggacaccctgctggcgcacggcggcgaccggctcaacgtggaggtcaccgagcacgcgcaggtcagcgactacgacctgctgggcggcgcgctggactcgctgcgccggaccgggatccggctcagcgtggacgacgccggcgccggctacgccagcctgcagcacatcctgcggctgcggccggacctgatcaaactggacatcagcctggtccgcgacatcgacaccgatccggtgaagacggcgctcggccggtgcctcaacgacttcgccaccggcatcggcgcgcggctgatcgccgagggcatcgagaccgcggccgagctggcccgcctgcgtgagctgggcgtcgcgtacgggcaggggtatcacctggcgcggccgggcgccctgctctagacggccgaccggacgctgtccggttcgtctttcccgcccgatcggacccgatccgcccgtccggggtggcggggcggggccccggtaggcaaggatcgaccggcgactgtgcggtcggtgccaggccgtacgatcaagcgatttcgcgagaccggagcaccatgtcctaccctgaaccgtccccgtccgacccgacgcagccgtcgacgccgccgccgtatcacccggcgcagccgccgtcgctgtacgcgccgcccgcgtcgtcgccgcccgcggcctacgacccgtacgcgtcgccgccgccgccgtcgtatgacccgtacgcaccgccgcagcagccgatctacgacccgacgcaggcatatccgggtgccggtcagccgagcgcgccgccgttcgacccgggctacccgccgcagcagcccagcccgccctacggctaccaggcgtacgccccggtcgtgatggccgtcggcatgcccacctcgggcgcggccgtcgcctcgatggtgctcgggatcatcggcatcctgggtttctgcctgttcggcatcccctgcatcctggcgatcatcctcggtcacgtcggcctgaacgagacccgcaacggcgccaagtcgggccgcggcatggcggtcgccggcctggtcatgggctacctgttcgtcatcccgacggtcatcttcatcgccatgggcggcatcggcggcctcagcgcgatcatgaaccacacctcgccgtgacctttcggcagccgtccggttccggccgggcggctgcttgcgccccaccccgccggcctgcttgacgagtagtcacccaggcactaaaagtagtgcgggacgagggggcggcatgtcggagaacgtcaaggtgatctcggaggccctcggcctcggtgccacggccgggccgtcatccgatgcggtgctggaggcgtaccggcaattcaagaaggatctttttccctgggtccgcggcgacgcccgggaggccctggcggccgacgagaccgaccccggtttctgggaggtcaccctcgggtcggagctgaccgattccggcgcggccgaggacgccgtgatcctggccgccgcgcggcggctggcggagctggtgaaggcgccgcccgcggcgaaatacacggtgacggtcagcggcagcgagggtgtgcagatcggcgaccacaacactcagaccaacaccttcggtgcccgctgacgggtgaccgccgcggcgaaagcggcggttccgatcaggacgaccaggccgctgtcgccggcgaggtactcgttgaccaccgccgggtggctggtggtgacggcgtacgaaccgagccaggcgaacgtggcgttgtgcacgaaatgcgccagcacggccggccacaggctgccggtgcgcagacgcaggcggccgatgaggaacgcgaaggcgatcacgctgccggtgaacagggcgagcaccagcgcccggtcgccgtcgtggtggtagtacggggtgaacaggatgtagggcaggtgccagaggacccagaccaggccgctgaccagcaacgcggtgcgttcactcagccagccgaggcggggcagcagatatccgcgccaacccgcctcctcggcgaatgccaggaccgggccggtgacgcacagcgcgaccaggtcgctcgcccacggcccggacggcacggtgaaccgggccaggccgagagccaccacggcgccgatcgcgagcaggttcacgccggcggtggccagcagcgcgaacggccagacgctcaggcccaggtggcccaggccgaggcgccgccagccggtccggctccagccttccctcgtgacgaccaccagcatcagcagggtgaccagcagcggtgagacggccaggagcaggccgtcgaacacccttgcggtcgtcgccgagatcgagagcaccagaacgatgtacgtcaacgccgcagcgcgatcagtgagtccccgtatcactcgtgcagtcttcggcagtcgccgtcgccggccatccgtccaaagtgggatcccggaaggggaacggtcggccgtagggcggagatcggcacttgccgagcggtggccgttccggaacgctggaccggtgggcacaccgttctatccggacatcccggtgatcgtgcggctggagattccgtcccggaccggcacggcgttcgcggtggacgtgcgactcgcctgctcggtggtcgatctgggtacgcacgtccgccacggggtgacggacccacgggaggcgctgcgccggcacctggaacgcatccggttcgacccggtggccggcgaaccggacatggtggcggtgttcacccggatccgggagcatctcgccgccgttccgccggtgctgcccggcctgtcggtgaccctcctcgcggtcgaacgatcggatccggtccggtggcagccgggcgtggtcctcaccgggcccccgccggtcgggccgcgaagctcccccgccgaggcggagatcgcccggcgggaacgggtggagcggctgcgacgggaggccgccgcacgcgccgagccgccgtcccgggccctcgtcggcgaggcgccggcccaggtccgggccggcgccgaggtcagcctgatcgtgcacgtggcgcgcgccgcgccggccggcccacgggtgcgcagcgcggccatgcggtcgtggccgatcccgccggccggctcggaggtcaccctggtcacgcacccttcggccgggctgacgccgctcggaccgatccagcaggcggtgcgggtgccgccggacgcggattcggacccggtgcggttcgcgttccgggccggggtcaccgacgtacaccggatcgaggtgacggcctgggccggtggcaccttcctggcccggctggtcttcgagatcgcggtcagcgaccgcgccgtccacccggagacggcgacgaagagcgccaccacggccggcgacgtcgacggtgtgcccggggccgtgaccatgcaggtccaccagtccgggaaccgatacacctttcagctgcacaacagcgagtacgtcttcgatccggtcaccgtgaccgtcgacaccgccgtggacggggtgctcggccgcatcctggagacgctgcgccggttcgcccgcagcgacgacccgccgccgatcgcccgggaatggctgcgcaacgccggcgtctcgctgtgggacagcctggtgccggaggcggtccgcgagcagtatctgcggctgcacggccggatcggcagtttcgcgatcgccaccggcaacgacgtgatcccctgggagctgctctatccgatgacccggacgcatgacgccgggttcctggtccggcagttcccggtgacccgcaccctgttcaacaccggtcgctcgcgccggatcaacatcggtcaggcgcgtttcgtccgggacgtcaaaggcccggcgaacgcggaagccgaattccaggcgatcggccggatcctgtcccccggccgggacccggcccggatcagcgacctggacgacctgctcgccctgctgtccggcggcgaggccgggctgacccatttcgcctgccacgccggttaccgcgacgacggcccggcgatcgcgatgaccggcggcgatttctcgccgatgatgctggccacggtccgggccaaggagatgctcgcgcccacccggccgctggttttcatcaacgcgtgccgctcggccggcgccgtcccgtacttcacccggatgatgggctgggcccagcagttcctgggcgccggcgcgggcgcgttcgtcggcacgctgtgggatgtccgcagccggaccgcgcagaccttcgccgaggcgttctacagcggcttgagcgaaggtaagcccctcggccaggccgccctgctcgcccgccgcaccgtcgaagacgactacgaccccacctggctcgcctacacgatctacggcgacgcggacgcgctcgccttccccgtcagtgaaggacgacagcattgaaaaccacagacgacggtgtacgcgtcgaagacctgatcgccgcggtgaagaacgccatcgacgaggccaacatctccaccaccgacccgtcccgtgacctgcgggtcagcaaggtcgatctgaccctgtcggtggtcgcctcccgccacggcggcgccggcctggagctgaaggtcccggtcatcggcacgaaactcggcgcccgctaccaacatggcacctccggcacccagaccgtccaggtcacgctgatccccccgcccccgtccggcttcgaagtccgcggcggcgacctggaggaatccctggtcgaagccatcaccaccatccgcgccgcgatcatcgcggcccgcaccggcgacgacccgttcgtgctggagtccagcgtcgtcaccctggtcttcgcggtcaccgacaccggctccatcaccctcctcggcgagggcgacctcaccgacgagcagacgagcacgctcgccctcaccctggtccccgccgaccacccctgatccccgccacccgccgacacccgtgcctcaccccggcccccgccgaccacccccgatccccgccacccgccgacacccgcgcctcaccccgatccccgccgaccacccccgatccccgccacccgccgacacccgcgcctcaccccaagccttgatccactcgccgagactcatgcctttcgctggaccgccgaggtgtgcctggtgggcagccggtcggtcaagccctgctcacccgaccggatcgatcccggtcacggacgggtgagcccgcgctgacctgggagtatcacggagtggcggtcgagacccgggtcgaccatgattcaccccatgacggcgaccgaccttccgcgctccggcccgcacgacgtcgactgggcgaagctggaccggggcaccgtcgtccgcacactgctcaccgacctgaccaccgacgatcccgccacccgggcagcggcccgccgcgccctgtgccgcaacgccccggacggcgaggatgtccgcccctgggtcaccgccgccctgccaacgctgctggccctggtcgccgatccggcccagcccgaacgcggccccctcctccacctgatcgccgacctcgcgggcgccgaccgtacgtggcagatgtccggcgagacgctgcgcgccaagcggctcctggcagcccatgccgcccagtccatccccacctcctccgccgccgcccccgccactcaagccggccccagcgcgcccaccaccctcgccgctgacgccgaccgagccgcttccagcaccgcggtgatcccagcgacccagctcgcactcccccgtcagaccgagcatgtcggatcttccggaaatgtccggagggtccgaccgtcgggagctgcactcccttcatctgactctcaccgtcgccctcggacgaactcggcgaatccgattccgggagcacgtcagcccgagtccgcgacagcggccgaagctgtttctccgaccggagcaccgccggcgtccgcacttgcggccacgcccgaagcgacccggggacctgccgcccgggccgcgaccgaggcgaccccggaagctgccgcccgagccgcaacacaggcgccgccgggagccgccgcccgagccacgacccaggcgccgccgggagccgccgcccgagccacgaccaaagcgcccctgggatccgcggccggcacctcggccgagacgccggccgagcctgcgcccggcttcctcgccgcgctgatggctgacgaggatccgctggtgcgggacgcggccgcctacctcgtgcgggccgtcgcgcgcctgcttcccggcctgatcgagctgatctggggccggtatgtcgaggagcccgacccggcggtccgggtcaccctggtgcgcagcggtgtggtcgccggcgcggtcggcagcggggtcgagccgaccaaggtgtggctggcgtgggccgccgacagcgacgcggatctgcgggtccggatcaccgcgctgaccgagctgatggcgctgctgaacccaccaccgttcgacgtggagaccgcccgggagacggtgctggccgcctacaaggcgggcctgaaccgggagccggcaccgctggacgatgcggtcgccccgctgctggccggccggcggatggcggcgcggcagtggacgccgggttatccgcaggtggtcagtgtggtgcggacgtcgtatcgcaacgacgtacgcccgcaattggatcttttgacccgcatgctggagttggatgccgcggacgcccgccaggacgcgctgcacgaggcgcgggccctggtgcggagattgcgcgccccgtatcggccgttggtggtgcgtgccgccgagctgctcggcgacgacgatccgcaggtgcgcgcggccgcgctgcggatgctgcacggggtcggcgagctggcgcgaccggccgccgatgacatctgggcgacgctgccgccgacccggcagcggatccgtcccggccagagcccgtgggtccaggccgacctgactctggggccggccgtgcgcaccctggccggtctgcgggacgaacgtgtcctgccgatgctggagcgtctgctcgacgagctgcccgggacggtcgacctgcaccggttcatcgccggttacggtgcccgtgcccggggtttgagtcgcaccctgcgccgcctgctgcgtgcggtcgagcccagcgcgtccgcccagcggctgagttttctgcatccggagacggtcgagttgccccggatcgcccagcgtgcacgcccgtcgtcgatcgcccagcgcgcggccggcctgttcggtgatgacgcgctgcgggccgccctgctgcgcgcgctgatcgcggtcgccccgcacgaggccgccgatcacctgacctacgacccgatcgacctgaccaccctggacctgctggcccgggccgggcgttccgccgccgcccggatccccgagatccgacttgcgctgacctgcggcgatccggcgctggagctggcggcagcgcaggcgatctggcgggtcgccggtgacgccgaggcggccgcctccgtttacgaccgctatttcgacgacccggccacgctccccgagcacgcggtcacggcgctggacggtctgcgtgatctgcggttgcgcgtcaagtcgcgcacccggcgcctggtgagcctggccaagacccgccgcaacggcgccgtcgtggtcgccgccgccgacgccctgtggtggatcgccggcaatcaggatgccgcccggactctcggcccggtctgggagtccctgccccgggcccggccgcgcatcgcccgcatctggacagacaccggcgacgcccgttacgccgcccgttacgtcaaggccgagctcgccaccacgttgcgccacaacgccacccttttcgggcggcccaccaccgacatcaacgaggacgagcacctgctggcgctctgccgcgacctgctcgcgaaagcctcctgaccgcaccgccgagcccggcatgccgccgccgatccaccgccgccccgtcgttctcaccggtcaagcgaatcaccgggcgtcacgccgccgccatgaactttggtctacggttcggtccgaaagtaggtgcgcggcgggcgggcggacgcgcgcggcccgcgcgaactggtcgtcccagcggcgcgcgaacggcaggatgcggtgtcgatggcgccacggcgccatctggcggaccgcgttgaaaccggccgcggtgaagacgcgcgcggcggaggcgaacaacggccacaccggatagtcgtcgatgtggtccacgtcggccggcaatggcgcgggacgcgacggggcggccagcagcagccgcggctgaacgttttccagggcggcgcattcacgggcgtacgccagcaattgtgtcgtctcctccagcggacccgcatgcgcgatcaaccatcgatcggcagcgatctcgcgggccggaacggagggcgggtcggtgagcgtcagcgagccgatcgcgcccgagtgcccggccaggaaggcggcatgcccgtcggtcagttcctccagcacccacgtctgatcaaaataggtcacatccaccggcagcatgtcccggtacgccgcccaccgcagcagccgcgcaagatgaaccgtccggatcttaggcggaatgaccgaagcatccagttcgccgcggatcccgcccgggaaagcgtccaccaccagcgtctccggccgcagctcgcgcagcacgtcggcgatcggcgcacaggccagccggtgcggcccgagcacccgcggatcaccgccgaacggggaggaggtcaccaccgtcgccggctcgtcgtcgtgcacggtgtggaggtaagcccggatccgggtgagatgtccgagcccgccgccctgcgcatagcagacgatcaccgggtcgctgccagcaccttcaggtagccgtcggtctcccgcgcgatcccgaagcgctcgcgcacccgccgcgccgccgcctcccccagcgctccgagctgctcatccgtcgcttcggccgcgcggtgcagcgccgaccggcagccgtgcggatcaccggcccggaaccggaagccgatcgtctcgtcgaccaggtcggcgagcccgccggcatcggaggcgagcagcgggatgccgagcgcggcggcctcgagggcgacgttcggcaggccgtcgtagaaggacggcagagcgatcacgtcgcaggaggcataaacggtcagcagctggtatcggtcctggaagggaaggatcgtgtgcgggtgcccgtcgaggggcattccgggctccaggtcgccggccaggatcaggtggaagtcgtgccgtccgggcgccagggcatcgagcagcagacggacacccttcttgttcttcaactggccgatcaggccgatcgtgcggcgcccgtcagtgacgtgctcggcgcgccacgcggcggctttccgactctcggacggcagcacctgccattcgtcggcgtcaatgccattggcgacccaggtgaccgggacgccgggcgctagagcggagaccagcggcgcggtggaactggcgacgacgcagacgtgcgcggacgatcggagtgcttcccgaacgaccggctgacggcgcagggagaacattccggtgtcgaagtcgttgccgcgcagcagcgtgatcagcggtttcccgctccacgcggcgtagaccggcgcggccagcagggggtaggtgccaccgaacgccacgacgtgcgtgtaggccgccgcttcgagcgaggtccacaacattcgcagcgcgtgctcggcatcctccccgagcggcaccgtgatcaagcggccgccctgctcaggggtgatccggccggcgccggcccgacggctgaggtggaccacgtcgacgaccaccccggctcggcgcaggccgcgcacgatccggtcgcacgagttcgccatcccgcccgggctgggcggatagttctcggtcacccagagcaaccgcatcagctgtccaccagcgcgtcgtccccgtcgtcgaggaaatcctgggtcgcaccggcgccgggatcgaaggcagcacggtcatacgtatcgaagccggaataccagacaacgtccgaatattcctgcgacgtacggtatcggtgtgcccgccgccggtaagcggccgccgccgcgggatgcgacacctggccgcgcgccgccgcacattccgggcacatgccgccctcggcgatgtggtcggcgcagatcggacgcccgcacgacgggcaggccgcgaccgccatcagcccgcatctccccagcgtgaagaacccggtggtgaccgtgcacggcgtcatcggatctcccccatcggcgacgtccagcggaacggttcggtggccacgctcagaatccggtcgatctgctcctgcgcgctgcgcggcaccgggtcgagcttcgcggcggccagcacactgcgccgctcgccctcccggaccagcacgccgatccagcccggcggcggcgtcaccggcacccggctgtcggcacccttcggcaggcgccggcgcacccggatggtttgcaccagtttgcgcttctgcttcgtcttgtacttgccgcgcgggttgcgtttggtgatccgccggcggcgttcccggtcgacgaccaggatctccagcacgctgccgtcccgcaggtcaccgcgcagccgcagccacggatcgatcacccaggcctcggtcgccttccggatcggcggccgcacggcgagcggcgcctcggggccgcacttgccgggcgcgtccaacccgcgcagatcggcggtgaccgacagtgttccctccggcccgagatccgagcagagctccaggatcaacggcaccaccacgtcgagggtccgcgccggcagcgcccacttgcggcgccggatcagcccggcatgctgctggaggctggtgacgaacgccgcccagccggccgccggcagggtcgcggcgaccccgcgctgcgcgatgagggcctggtgcagcgggtggaaccccgcgatggccgccttctgctcccgccagaacatgatcggacggtatcagtgctggtctacccggtcatacacggcggccagccgggcccgcgcatgcttccaggtgaagccgtcctcgacgtgccgccgggcgcgctgcccgagatcgcgggccaccgccggatactccagcagcacccggatcgcccgcgccagctcggccggccggtccggtggcaccagccgcccgtacccgccgagcacctcccggatcaccggcagatcggaggcgaccaccgccgtcccggccgccatcgactcccacaccttgatcggactgcatccctgctccaggttccgcgggccggcggtcagcggcgccaccgacaactcggcatgcgtgagccaggccgccacctccgcatgcggcaacgtgtactgccaccggacccgcgcgctcaccccgagccgctcggcgagccggaccagcggccgcgcccgggccggcgacaccgacgaacagatcaccagctccaggtcggtcaggtcggcgagccgggcgaacgcccgcagcaacacgtcgacgccctgccagggctgcagggcacccacatagatcagataccggcccggggccgccgccggtcgtggcacatccggcggcaccggatccgcgccattgggcaccaggtggacgttttccggcgccacgccgcgctcgatcacggccgcttcgatgacgtacgacggtacgacgaccgccgcggcccgccgcaggcacctctcctccagtgcgcggaccttggcgagggtcgtgggagcggccagcggccaggcgtacggcagctcgatcgacggcagcccgttggcctcgtagaccagccgtccgccggcatcgagcgcgggcagtgcgccccacggatcccgcacgtgcaccagccgcagcgtgccccgatgcggcgcgagccgatcggacacccaggcggagaacgcctcggcccggtccagcagattggggatcacctcggtgaaccggacgatctccacaccgttctcgaactggtaggccggcaggccgccaccgccgagcacacagagcaggccgccgccgtaccgttcgaacaactcgccggccatgtgccggatgtgcaccgccgaccccttggtcgagggaaaccggtcgaacgcgatgtaggcagcccggtggccgccacttcgcggcgcacccgctcgcggatcgtccggcgtcccgccctcccgggccgggcctcggcggtcgtcaggcatggctgtgctcccgtcgccggcttcggtgccaggcgatctgctcggcgagcccctcgtccagggcggtgcgggcccgccagccgagcaacctttccgcccgtccggtcgcggcccacgtccgggtcacgtcgccgcgcgccacccccgccggcacggtcgggggtgtcgcgccgagcagcaccccgatccggccgagcgcctcccggaccccgacggtcaccggatgtcccacattcagcaccgtcccgggcggcagcggaacctgcgcggcccggatggtcgccgcgacgacatcatcgacgaaggtgaaggaccggctctgcccgttgccgtacagcggtgccggctccccgtcgaggcccgcctcgatgaaccggtggaaggccatgtccggtcgctgccccggcccgtacacggagaagtatcggagaaccaccgccggcagcccgtcctctgccgcctgccgcgccagccgctccgccgccgccttcgatcgtgcgtagggactccgcggcgagatcgggtcgtcctccgtgcagggatgctccgcactcccgtagaccgacgaactggacgcgagcacgaaccgtggccgtgtcctccggcatgccgccagcagccgctcggtcgccacgacattgtcccggtgagcgtcggctgccccggaaccccacgaggaccgcacccccggccgccccgcgaggtgaaagaccacatccgcgtcgaccagcccggtgagatcagccgtcgcaagatcacagtgggtcaacggaacccccagtgccgccgcgttctcggcggccgctgcgggcgccccggcccgctcgatcgcgtccaccgccacgacgtcgtgcccgtcgcccagcagcgctcgcacgagccggcttccgatgaaccccgccgctcccgtgaccaccacccgcaccccggcactctagccgaccacctgcgggctgaccgggacctgtcaccggtcgaggatgcgcgggacagcgagacgccgaccgcggcgggccgggaaccggtcgtcgacgccatctcagccgagcccggtcgcagggtcgccgctgagccaggcgcgaacgagatcgctgtgctcccccagccgcggcggtgctgccggaggtcgtgttgcggcgttggcataccggacggggtgccggatctgcccgtcgacgaccgggtccaggcccagatcggtggcccggtcgatggcctggccgatgtcgcgcaccacgccggcggcgatgccggccgccgtgagacgccgctcccagaccgccgcggtctcggcggcgagcgccgcttcgagggcgtcgaccagtacctcccggtgcgccacccgggacgggttatcgacgaaccggtaatcctcggccagtcccggtacccccagaacggcgctcagtcgggcgaactggcggtcgttcccgcaggccaccgcgatcggcacatcggcgcagcgcagagtctcgtacggcgcgatcgacgggtgccggttacccatccggccgggcgcccgcccggtcgccaggtagccggacgcctggttgaccagacccccgagcaggctggacagcaggtcgacctgcacgtgatcgcccgcgccggtctcgcgccgccggtgcagggcggccaggatcccgatcgtggcatccttcgcggtcagcacgtcgaccagcgcgacgccgaccttcagcggctcgccggtggactcaccggtgatgctcatcagcccgccgaccgcctgcacgacgaagtcgtatccgggcaggtcagcatccgggccgaagccggtgatcgagcagtagacgacgcccgggttgatcgccgcgaccgacgcgtagtccagcccgaaaccggtcagccgcaaattctgcaccatgacgtcggcccgggccgccagggcgagcgcggtcgctcggtcgccggggtcggacaggtccagcgcgatgctgtacttgctgcgattgagcccctcgaaatacgccgatgaatgcgtcccccacggcggcccccaactgcgggtgtcgtcaccactcccgggccgctcgaccttgatcacggtagcgcccagatccgcgagggtcatcgtcgccaacggcccggcaagaacccggctgaagtccgccaccaccagtccggcgagcggccgggcatccgccgacaaccgaccctccgacggccgcccatccgacagcggctcctcgttccacatccggccgccgtccgacgactgaccgcccaccgtcggctcgccgctccatgaccggccgccgtccgacggctgaccgcccaccgtcggctcgccgctccatgcctggccgccatccgacagcggctcactgtccgccgatcgatcgtcgggcatcggcatgcggtcccgtgggtcagggcgacccgaatgcggcccgatcatcggcgcacctcccggcgaggaatgccgcccgggcacggacctgccggtccgcgggtcaaatgaggtcaccttgggattcgatcacggttgggccaggatggcgtcgcctgcggcagcatcgctgcggtcatccgacttcgcggcaaacatgtggatcggccctgtgccgatgaccaaagcgattcgggtaggcaccctgacccggcaccgacctgaatgttgcccagtcccgagccgctctgctcctcgcactgttctcccgccgcctctgacatcgctccctgctgacttgccgcgctcggctccctcctgccgtgtccgcctcactcggcaccgctatccagcgttcgcctcgctaccccgccgtcgacggcgagggaggccgatcaggggcagaacacgctggtgatggccttgaagtaggcgggacgggcgtccggggtcgggtcctcgcccggaatgtcccgctggtcacggcccaggtcgaagacgttggcgacgagcacgagttgccgcgcggcgccgggagtcgtcatcgacagactggtgaaccccggtccaccgccgtcggtctgccagaccgtcacctgggcgtcgccgcaagggatcgtcccttgctggaccccgagcccataattctgttcgaacaccgtcgtctgcagctcacgctgctggacgggcttcaacagccggccgctgaacagcgcggcgtcgaagcgcgccaggtcagcggtggtggaaagcatcgccccggctgtccactcccccgacgggttgaagtgcgtcacgtcgcgataacccatgtcgtacccgtgcaggtgcgggccgggaatccgggggtcggtgagcgggaaggacgtgtgcttgaggcctagcgggcggaggatccgccgctcgatttccttgtccacggcatggccggagaccgcctcgacgatcatgccggcgagcaggtagttggtgttcgagtagtcccactgctgcccggccgggaacagcggcggatgggccatggcggcgtccaccacctgctctggggtgtgcccgcccttgtcggtgccgaagaccggatcgttgcccgggtcgtagatgccactggtgtggttcagaagttggcgcacggtgatccgtcggccgtcattgccgttgccccggacgacacccggcagccaccgctcgatgctgtcgtccagactcaggcgtccctcgccctccaactgcaggagaacggtggcgacgaatgatttggtgttgctgaagatccgccatcggtcgccgggctgggcggcccggccggatgccaggtcggcggtcccggcggcgagctgccaggagcgaccctcacgtcgtacataggaaaggactgcgggattgcccgcgctgaccgcctcatcgatcgcctcccgcagggcggcgggcggagaggcgggtggcatcgcggcatgcgcggcgccaccgaaagccaacaatccggtcgccatcgtgcctgcacagatcgtttggagtgcggtcgtcttcatgttcgctccttcgtcgaggtccggcttcgactcttccggttcgacggcgtcgattcgaccaggcagtccccccaatcgacccccgggatatcccggtatccacaacgggggctcaccgggtgttccgtccccgcccggtcggccattctggacgccatgaagcggttctcgtacgccatgctcggcttgccgttgggcctgttcggcctgttctacgtggcgttcgccatcgttgccgggtcggccttgtcgttcacggtggtcgggctgccggtgttggccgccgggctgcgcggcgcccggctcctgggcacgctgcaccaccgtctagcccgacggctgctcggattcgcgggtgccggaccgaccactccgccgacgggcgcgggcttcttcgactggctcaagaccggcctgaccgatcgcgccggctggcaggctgcggtctacctgctgatcaaagcgccgctggccgtgctcaccgccggagttgccatcttcttctacggctacgggatcgcggggatgacctatccgctctggtggaaactcgtgccgatacaggacggccacgccggggtgccgctgcccggcaatatctatctcgacaactggggccgagccgcgctgatctcatcgctcggcgcggggctggtcttggccgctccccgcatgctgcgtgccgtattgctcttcgaccgcctggccatcggcgccctgctcggccccggcaagctccgggaacgggttcgcgagctggaggagagccgcgcgttcgcggtccaggacaccgccacgatgctccggcgcatcgagcgcgatctgcacgacggcgcccaggcccggctggtggccgtggccatgggcctcggcgatgccaaggaacggctggaacagaccaacgccgacccagcctcgcggagactgatcagcaaggcgcatcaggacgcgaaggcggccatcgtcgaactgcgcaatctggcccggggcttccatccgcccagtctggacagcgggctcgacgtcgccttgaccacactggccgcgcgcaatgccatcccggtggagctgagtgtcatccttccccggcggccgccgctggcggtggagacgatcgcctacttctgcgtggccgagcttctcaccaatgtggccaagcacagtcgggcccggcacgctacagtcgccgtccgcggtgaacgggacaggttgcgattggtggtcagcgacgacggccagggcggggcccgccccagcggaggcctcgtcggcctcgccgatcgcgcacgcactgtcgacggcacgctcaaggtcgacagtccgcccggcggaccgaccatcgtgaccgtggagctgccgtgcggatcgtgatcgccgaggacgccgccatgctgcgggccggtctgaccgacactctggtcaaccgtgggcatgaggttccggcggcagtcgccgacggtgacggcctgctggccgcggtggcgaagcaccgaccggacgtggcgatcatcgacatccggatgccgcccacccacaccgatgagggcctgcgcgccgcgatccagatccggcgtgatcacccggatgtcggggtcatgctgttctcgcagtatgtcgagagcaggcacaccaacgccctgctccgcggtggggcgcagcgactcggttacctgctcaaggatcgcgtcgcggacgtcagcgagttcatcgatgcactggcccgggtcgctgccggcggcaccgtcctggatccggaggtggtcacacaattattcaattcgggggcgagccgtgggcggctgtccggtctcaccggccgagagcgtgaggtactggccctgatggccgagggccgatcgaacacggcgatcgccgagcagttggtgctcgcctatgcgtccgtcgagaagcacatcaccagcatcttcaccaaactaggtctgccagcctcggccagcgatcaccgtcgtgtcctcgccgtcctgcagtacctgcgcgtcgaaaccctcaccgaccccgccgccacctgagccgctcggcccgagcaacgccggtccggtgatccccagcgccacggacggcacaccgaacgcaggcgtggaagcaagcgcgggcggaagcggcgcgggctcggacacaagcgcgggcggaggccccgcgggtccgggccgcgcgggcgcgaaggcggcgcgggcgcgaaggcggcgcggcgcgaggacaggctgcaggggtggcgcgggcggagttggcgggggggtgtcgacgttgaggaggtgggcggggccgagggctggaaagagggtatctacgctggtcggatgggatttcttgacgtgattgggtgggcggggtcagcgctactggtgtggtcgctgatgcagacccggctgctgcgcctgcgggctttgaaccttgtgggatgtttggtactgatcgggttcaatgcggccctcggggtttggccgatggtggggctcaatgtggtgctgtcggtgatcaacgtttggtatctggtgcggatgctggctactcggcacgacgagaaggcttatcaggtggtggaggttcggcctgatgacggggttctgacgcatacgctgcagcggcatcatgacgacattgtccggttcaatccggattttgtgcctcaggagctgggcgggcgcgaggcggcagccttcctggtactcaacgctgacgaggtcgctggcgtggtggtgttccacgtggcggacagcggggttgcccaggtggagcttgactatgtcaccgagcggtatcgggacttcacaccaggggagttcgtctttcggcggagccggttcttcgcagatcggggctgccacacggtgatcactccgccgggcatgcaggcgccttactacgggcggctgggcttcaagcgggacggcgaatcgtacgtgctggagctggctggctgaggccaccgcgagtcgagcggccgcctggaaagccggggcggccgcctgatggacggcgtccaggctggctcgcacgagcacggcaaccagcgcaacagcgagctcggaccaacaggggcggccggcgcaacagcgagctcggacgagcgcggcggccgacgaacggggcttgaacgagcacggcggccgacgaacgggggcttggacgcgcacggcggcgacgaaacgggggcttggacgcgcacggcgacgacgaaacgggggcttgggagagcgggtggggcgggtggtcggtttgccggaagaggcaggtgctgggtcggggcggtaactcccatcgatgatgggaatgtaacggttccggcacggagggagcctctgatgtccttcagctggccgtatgccctgaccgcgctcctcctcgtcccgctgctgccggctgcgcgctggtggttcaaccgtcgtcggaagcgggccagtctcgtggtctccgatctggggcttgttcgggcggctgtgcccgggcgcggtgcctggcggcggcggataccggcggcgctgttgctgtgcgggatgctggcgctggcgctcggtgtggcccggccgcaggcgaccgttgccgtgccacgggcgaacgcgtcgatcctgctggcgatcgacgtgtccgggtcgatgtgttcgaccgatgtggcgcccaaccggctggccgcggcgatcgacgcggctcggacgttcatcgaacgcagcgatcgggggacgcggatcgggctggtggcgttctccgggaccgccgggctggtggtggcaccgaccaccgaccgcaaggaactgatccgggcggtggggcggttccggacagcgttggggaccgccatcggggaggccattctcaccgccatcgatgcgatcgccgagtacaacccggcggtggccgcgagtggggtggatctgatcagtgacaacagcggcgggtttcagccggacacgatcgtggtgctgaccgacgggtcgaacaccaccggggtggatccgctgatcgccgccggtcaagccgcggcgcggcatcttcgggtgttcaccatcgggttcgggacgacgacgcccgggccgatggtgtgtgatccggggcaggtcaccagtgggtccttccggggcgggccggatccgggcggggcaggcggcgggagcgcgtccgggcagtcgctggaaatcgatgagaagtcgctggtggcggtggccgagacgaccggcgggcggtatttccgggcggccgacgccggacagctcaacagcgtcctcaccgacctgcccgccgagatcgggctgcaccggcagaagaccgagatcaccatgtggtacgtcctgggcggcaccctgctcaccttcaccgggctgacgctgtcgctgtggtggagccgtcccagcctgaaacccacccgaaagtgagcaggccgagggcggaactcgagtttgggggcgcgcagggtaggacggctggtgggggcgcgaagctgagccgaccacgggcgctgatgggggcacgcgaagctggcccgaccacggcggctggtgggggcgcacgaaactgaaccgaccatgggggcggggccgcaggtggaaccggagcggcggcgtgcgaagccggcccgtccatgaggcgcggcggctgatggcagcggagcgggggcgtgcgaagctagcccgaccagggttcttcgagtgaggttttcgatggggcgacttccggccgggcacgcagccgcccggcttcgggcaccgaagcggaccgaggcggggcggcaccagctgatcgacgcggtctgtgcggtggtggccgagcgcgggcatgagaacacccggttcaccgatgtggcgcagcgggccggcacgtcgatcggcagcctgcagtatgcgttcggcacccgggagaacatggtcgccaccgcgctggacgagcggaccaaccgctacctgaccgagattcaggcggccggttccggaatcgccgatccgctggcccggctccgctggctgggcacccatctcgcggccggcctgggtggtgacgacgcggcccggctggaatggctggtctggaccgaatgctggcgggcctcgctgcgcgacgaccggctgaaggcggcttcgacggcgcagtaccggaactggatcgcgatgatcaccgaggcgatcgaggactgcgtgacggccggcgtgatcgccgaaccggacgacactcatgcgatcgccgcggcggcgctcggtatggctgacggtctgggtgtccaggtgtcgttgagcgaccgtgacttcggctgggaggacgccagccggatggtccgttcctggctcgccctgtccctgaactgccccgacctgcgctaacctgccgcggcgcaggctgcgaaaaccaccggaaagcaaccgctcggcaacccgggctggcgcggatcttggtatcgccatactatacggccataccaatcgaagcggagcagtcatgtacgagcaagcggatgtagtcgtcgtcggcgccggggtcaccggcctcaccgccgccacccggctggcggcggccggcttgacggtcaccgtcctggaggcccgtgaccgggtcggcggccgcctgctcggtgccgaggtcgacggtgtccccctggagctcggcggccagtggatctccccggaccagaccgccgccctggcgatggccgaggagctgggcctggacacgttcccgcgctaccgcgacggcgccaacgtctaccgcgatcgggccggggtccggcacacctacaccggcgccgcgctgcccgtgtcggcggcgaccgcccgcgcgatcgaggcgatcagcgacgaggtggagcgcctggccgccgagaccgacccggaccgcccgtgggcgcacccggacgccgagcgcctggacagcatctcgttcgccgactggctcgggatgcgcaccgacgaccaggaggcccgggacaacgtcgcgatgttcctggcctcggcgatgctgaccaaggcggccgacgagttctccaccctctcggccctgcacatggcggccagcgccggcggtttcagccacctcaccgacgagaatttcgtcctggaccgccgggtcgcgggcggcctgagccaggtcccgcgcctgctcgccgagcgcctgggcgacatcgtccgcttgaactcgccggtcgagcggatcacctgggacgcggacggcgccacggtcgccacggcggacggcagcgtgcgcggccgccgcgtgatcctcgcgctgccgcccaccctgatgggccggatcaccttcgagccggcgctgcccgaggcgcagcggcaggcgcaggcacaccagtcgttcggcacggtgctcaagatccaggtggcgtacccgacgccgttctggcgcgcggccggcctgtcgggcaccgggttcagcccgtaccagatcgtgcacgaggtgtacgacaacaccaacgacgaccgccccgaggaccgccgtggcgtgctcgtcggcttcgtctcggaccggcacgcgcgggcgctgctcgacctctcccccgcggaccggcgagccgccgtgctgaactcgctggcctcctacttcggcgacgaggcccggcagccggtggcctactcggagagcccgtggctggacgagaagtggaccggcggggcgtacggcacgagcttcgcgatcggcgccttccacgagtacggccggcacctgcgcgaggagaccggcccgctgtcgttcggctcggcggacgtcgccggcctcggctatctgcacgtcgacggcgccatccgggtcggcgaggaactcgccaacgcctccatcaaagccctgaaatagcgccacgaaaggggaaaagtaggacggcgtgatccacgtcgttctcctgctcgcctgtgccgtcgtcatctacctcgcctgcgagtggttcgtcaacgcggtcgagtggctcggcgtccgcctccgggtcggcccgctggccgtcggcacgatcctggcggcggccggcaccgccctgccggagagcgtggtcaccctgatcgcggtcctcttcggcggtggccatgccggtgacgacatcggcgtaggcgcggcgctcggtggcccactagtggtcggcaccatcgcgtacgcaataaccggcttgatgcttttgattgtcaaaatgccggacctgggaggcaccgatctgacccggctggcccgcgaccagacctggttcctggccatcttcgtgttcaagatcggtctcggcctggtcgccttcgccctcaaaccctggctcggcctgctgttcttcgtcgcctatgcgatctatttccgcaaggagacggccgacaccggcgacgccggcatcgtggacgatctggagccgctgaagctgcagccgcggcgggagagcccggccaccctcgcggtgatcgtccagagcctggcgacgctggtcgtgatcttcctggcctcgcagctgttcgtccggcaactcgcctgggccggtccggcgatgggcctgtccccggtggtcgtcgcactgctgctgtcgccgatcgccaccgagctgcccgaggtgatgaacgcggtgatctgggtgcggcagggaaagacgccgctcgcgctggcgaacatctccggcgccatgatgatccaggcgacggtgccgtccggcatcggcctgctcggcaccgcctggcgcttcgacaccccgctgatcctggccggcaccgccaccatgctgtcggtcgtctatctgctgatcctgttccgcaccggccgggtcaccccgcgcctgctctgcgtcgccgtcgtcttctacctgctgttcgcggcgggcctgatcgccgccggttaggatcgccggaccggacgaacgccggcccgcgccgtcgccgggctggagggcagggcccatcctgacccgggtgagccgcgtcgagcgggccgagcagaccagagccaccatcgtgcacccgtcagccgccgatcgagcgggacaggttggcgatgctgacgaccagggcgttcaggtaggcgtcgacgcggcgcacggtggtggccacgaccgccagccgggcggtgagcagcggcagcggcacgacctcggattccagggaccagccggcgacccgggcgatcaggtcgccgatcaggccgcggacgatgtcgcgggtgagcaggatcaggtcaccggcggccttggtgagggcggtcatcgcggtggaggtggcgaccaggccgcgcaggccgaccacattgttcgacatgatggccaggtagccgcggacctcggggctgctccggccgcggaagtcgtggtcgaggcagcgttgcaggtcgtcggcgatccgttccagctcggtggccatccgcccccaccggtcggcctgccgggccaccacgtcgggggcgccggccaggtcgtcgagcatctgccgcagctcgggcacgtgggtgaccgcccagtggagcccgcccacgcgcagcgcgccgaccaggtcgccgaccggggcggcgaattcggcgaccggggcggcctcggcgagcagcggctccacccactcccgggcggcgaccgtgtcgagcaccccgtcgatgatctcggtggccgagtcgtagaccgtgatgtcctcgtcgaccggcatgccgatcatcgcgccgaaggtctccgagccgtccgcgacccggtggaacccctggacgaacagcagcagggtctcctcgatgtaggcgaccagctcgccgtgccggaccacccggtcgccgagcccggtgaggatccagccgcaccaggcaccgaacgcggcctggtcctgctcgaactcgccgacaccggcggcgatccgcccgagccgggcccgcagcgccgcgagatgcccggcgtggatacgaaacggcatcgccacaccaggcaccctagccgccgccgcgggtccgggagccgctcgactcacccgtccggggaccctgctccacaccccggggccaccgatgcgtcgactttcgggtggcccacaatcccgtaccgggaaacggaatccgaccgacgccggggcgggtcgccgtggcgggccgctcagttgccggcgctctcgtaacggcgcagcccgcggcggaagatcagcagtgcggcgcccaggcagtaggcggcgaccagcggggtgagcaccccgacccacggcgccgcgccggcgtcgaccaggtaggcgaccgggaagaagctgacgaacgcgaacggcaacgccactccgagcaccattttgagcgccgccggatagatcgacagcgggaaccgggcgaggtcgccgatctggtggacggcgaacccgaacaacggggtggggctgctcagccagaagaccgcggcgttggtggccaggttgatcgacactttgatcacgcacgcgccggccagcaggagcactgccagggcgacccgccaccaggtccagtcgacgccggcgtgcgcggcgccgacgccgagcatcagaccgccggtgacgatgttgctggccccgttgacgccgatctcggcgctgctcacctgcagcaccaccgggtagggccggaccaggaagtagtccagttcgccctggttgacctgccacgccatgcgccacatgccctcgaagaacagcgagccgacgccctcggcgacggcgaccgcgccgaacatcatcaccaccgcccagaagctccagccgttgagccgcggcacccgggcgaacagcgcggacaggaagacgacgttgaccacctgggtgagcacggtggcaccggcgagcaaccagaagtcggtctcgtattcgagcatggaccgcaggtgggcgccgagcagccggcggtagagccgcagcattcccatggtcagcctccgtggacggtgagctggcgcagggcggcccgccagatcagccgggcgccgaaccagagcgccaccacccagccgagttgggcggcgaccagggcgaggccgcggccgacgccgacctgaccgacgaagatcaacgcgggggtggacaccagcccggcgaacggcgaccactgggcgaccgcggccagccagccgggcaggaaggcgagcgggatcagcgccccggacagcaggttgaccagcgcgatccgggcccactgcacgccgatgaagttctgcgtccagaaacaggccagcgtgctcacatagacgatcaggaatttcagcggtacgagcatcagcatgctagccgcgaacagcgccagcgccgcgccgggcggggtcggcaccccgccggtgagggccagcgtcacgccccccaccaccacgacgaccagcgcttccagccacgtcccgccgagcgtctcggccagccgggcccgctggaagtcgacgggtttgatgatgtccagcgcgaccagcccgctctggatccgggcggcggtgcggaagtccccgaacaccgagaccagggtgccggcggcgaacgcgaccagcaggtaggcgcgcatctgcggccagccgaagccctgcaccgcggacccgtcggcgagcaccacccgccacaccgcgagcatcgcgatgaactgcacgaagacggcaccgagacccaggaacagattgttcttgtacgccagggcggaccgcgccgtggcccgcgcgagcgcccggtaggccctcaccgggccgcccggttctcgtcgaggaccagctctccggagtagacccggcggatcacgtcctcgatcccgggctcgtccatccggaagtcgaccaggctggtcagcccggcgaccgcggtcaccgcctgcccggcggtcatggcgaaccgatcgaatcgtacggcgaaccgggtcggggtctcctccgcggtgaccgccgcgccgggcagcgccgcggcgagcgtgtccagcggcaccggctgctcggtctccacgtgcaggatccgctcgcgggcgaaccggtccttgacgctctgcaggtcgccgtcgaagatgatccgaccctcgtcgatgatcaccagccggcggcagaagccctcgatgtcggccaggtcgtggctggtcagcatcaccgtggtgccctcgtcgcgcagggtgcggaagaactcccggacccggtccttgacggccaggtcgagcccgatggtcggctcgtcgaggtagaccacctgtggcccgtggatcagggcggcggccaggtcggcgcgcatccgctggccgagggagagtttgcggccgacgatcggcaggatcccaccgaggtcgagcacctcctcgaagcgggccaggcgggcccggtacgccgcgtcgggcaccccgtagatgtcgcgcagcacggccagcgactcggcgaccggcagatcccaccacagctgggtccgctggccgaagaggaccccgatccggtgcgccaccgcggtgcggtcgcgttgcgggtgcagcccgtcgatccggacctcgccggcggtcggcaccaggatgccgctgagcagtttcacggtggtcgacttgccggccccgttcggcccgacgtaggcgaccgcctcaccggcctcgatcgacaggtcgacccggtcgaccgcgaccttgtcctggtagcggcgggtgaacaggtgccgcaccgagccggtcaggccgggacccttgtcgggccggcggaacaccttggtgagcccacgagcttccacgatcgacatgcaggaatcccccgtccggtccgccggcgatcgccaacactctatggaaccggttccggggccgcaaacgagatcctcggacggcccacgtgacgggcaccgggccgccaggtgtcatcggcgccagccgtgccgcgggtcgtagccgagcaggcggcgcgccttgtcgatggagagcagcgtctggtgctcgccgatctcgcgggtcagcggcagctccgggaagtactcggcggccagttccgcggtgggccggctcatcaccgtgtccgcgttggcgatgatgaagatctccagaccggagcggtcgtacgacagggcccgccgcaccgcctgcgccccgtcacgggcgtcgatgtatccccacaggttccagatccgccggcgcgggtccgcctcgaaggacgggaaggcggcgtagtcgtccggctccatcacgttggagaaccgcagcccgatcatcgtgagctcggggtcccaccggcagaactgggcggccatctgctcgtcgaggtgcttggccagcgagtacgacgtctccggccgggccgcgtactcctcgtcgaccggcaggtacggcggtggggtgtcgaacggcaggcccagcacggtctcgctggacgcccacaccacccgcttgatcccggccgcccgggccgcggcgaagacgttgtagctggcggtgatgttgttggcgaaggtcaccgcgttggtcgccacgcccggccccgggatggcggccaggtgcacgaccgcgtcgatcccggtgtagcggctgtcgatcgcggtgagcgcctcggccacctggccgtaatcggtcaggtcgacccgggtgtgcgggcacaccgggtcccggggcggctcccggtcgaggttgaccacctcgaagtcgtggtcgagcaggtcctggacgacggcgcggccgagcttgccgccgccgccggtcaccgcgatacgtggcatacccggactctaggcgggaacggcaggcatgtctgatcatcaccggcggaagatgagcactcagcaggaaccgcgaggagtggtcgcgatgatcgcccgggccgcgccggcggccggatcatcgtgacccggccgccaccggagcgacgatccgaggtcggccgcggcatcggacatcatgaaggtgatccgccgatatttccgccgcgcggggttcatccgccgaccgggtcggcccgtatctccgggcaggtatttgcacaacgagtgcgaatagacggagaggagaatcgatgtctccgaacaggttccggaagcggatcgcgctgaccgccgccgtcgccgtcgtgaccggtggcgccctgctcatcgtgcagaacagcttcgccgcgacgatcccgggcgccggcgggagcaccgccggccggcccgccacctccgcggcggccggcaccgccgcacggccgggtgccgccacccgcgccctgcccggcgccggcacccgggtcgcctcgaccggcgatcaggccgggaagtgtccggatgtgcacatcatcgtgacgcgggcctcgaccgaagcgcccggcaccgggatcatcggatcgctggcgaccgcggtgacccgggccagccggcagaccgtgaccgtggaggccaccgactatccggcggcactgaacccgtacccgccgagcgtcgccgccggcaccagggccctcaccgcccaggtcaccgccgaggccgggaactgccccggcaccaggatcgtcctgatgggctactcgcagggcgcgcatgtgatcggtgacgtgctggccggcaccggccgggtcgccggcttcaccccgaacgccgcgctgtcgaagaagaccaccgaccacgtcgccgcggtgatcctgatgggtgatccgcggtacgtgccgggcaagtcgttcaacgccgggacctcgaagacccgcggcctgttcccgcgcggcggcgacgcgccgctcgacgccttcgcggcacggacccagtcctactgcgacaccggcgacacgttctgcgccggcggccggagcgtcgcggtgcacctgagctacacccgcaggtacaacaccgccgcccgggacttcgtcctgaaccggatcggcggctgatccgcggcggccgcgccattgctcaggtcggctcaggcggccacccggccgtcgcgccggacccggtccgcggaccggcccgttcccgggccggtctgcaggatcaccaccgaggccagcaccaggacgccgcctgccacctgcaccggggtgaggcgctcgcccagcgtcagggcggccagcgcaccggtcaccaccggttcgaaggtcgacaggatggcggcggccgacggcccggtacggcgcagcccggcgaagaaggcgagcatcgccaccaccgtggacaccaccgcgatgcagcccagccacagccagccggccgccgggaagccgaagtgcaccccgccggtgagcagcgcgcgtaccccgagggtcaccgccgcgccggccatcaccagggcggacagcacgaccggcggcagccggcggaccacggtgtcggcgaccaggatgtagccggtgtaggtgaccgccgcgccgaaggccagcaccgcacccaccggccggaagccggttccgccggccccgcccagcaccagcagcgtcccgccggacgccgcggccagcgccaccgcacggccccgggtcagccggtcccggccgagcagcaccgcgccgatggtcaccagaaccggataggtgtagaggatcagcgccagcagcgaggcgtccatccgctccaacgcggcgaaatacagcgaggcctgcgcggcgtagcccaccgcccccagccccagcgcggtcagcacggcccggccgcgacccccgcccggcggcatccggcgcagcgcgggaccggccgccagcaccatggccagcagcagcgcggccagcgtgaagcggaccagcagcagggtgccgggggtgacgcccacgtcgtacgcccattttccgaagatcgccatcgcgccgaaacacgcggccgagagaagaaccagcaacggacccatgcgcccagcttcggcgccacgacccatcaggtccagcgatgatttccggaggtgaatcagtaggattcccgcatggtcgccctggatctgcgccggctgcggttcctgcgcgagttcgaggagcgcggcacgctcggcgccgtcgcggcagctctcggctacagcccgtcgaccgtgtcccagcagctggcgctgctggagaaggaggtcggcgccaccctgttcgcccgcgccgggcggggactgcggctcaccgacgccgggcggctgctggccgggcacgcgcgggtgttgctcgccgcggccgaggccgccgaggccgacctggcggcgcctagctagctagcggcggcctgcagtccgccgcccgccggctgctgatcccggcgctgacccggctggccggccggcatccgcgggtccgggtggagatctccgaactggagctggagcaggccctgccgagcctgcgcctgggcgcggtcgacctggtgatcggtgacgagtacgacggacatccccgcccccgcccggccggactgcgcttcaccgtggtgctcgccgagccgctgcggctcgtgctgccggccgcgcacccgctggcccgcgccggtgggccggtcgccttcgccgacctgcactccgcggtgtggacgagttccgccgagggcaccgggcaccacgccatggtggtcggcacctgccgggcgctgggcggctacgagccggatctgcggcaccgctcaaacgatgcggacgtgcagctggagctggtccgggccggagccgcggtcgcgctgatgccaccgctggcgctgccggtcgccgacccggcactggccgtgcgggaggtcgccggggccgcgctgggccgccgcctgatggccgtcacacggcagtccgctgcggcacccgccctgcatgccttcctcgacgcggtccgggcgcaggcgcggtccatcgcctgaccccggtcaccacccccgcgacgatcagaagaccgagagcggcgacgacgacgatcagcggtacgtccggtccgggcgccgccgtgaccgtcgcggtgatccagccggccagggtgtcggtgcgcgcgctgctgtccgggccctcgtgcgggcacgccggtcccccgctgaccaccgccaccagttccggcgcgccccctcggcgctcccggaagtacgggccgccggagtcgtgcaggcaggcgctggtcgctcggcgcggcgcccgcccggagatctgcagcagctgctcgccgacctggtcgatgacgaactgaccggtctgcatccgggccggcaccgtcccctggtcgtcggcgaagccgaacccggtcagccgcacctgctccccctcggcgggcgcggtgtcgccgacccgcagcggcgtcaccccggtgacctcggcggccagccgggccagggccacgtcggcgccaccggcctgcacgacggcgaccacctcgatctcctgaccgccgaccgtcgcggtggtgcggtcggccaccgtccgggacacgtgccggccggccgcgtcccggaagcagtgccccgcggtgatcacccagcgcggggcgatcagcgcacccgagcaccagctgtcccgggtcccgttctcctcggtcgggatgccggtcatggtgagccgggtggagaacgcgtaccggccgtcttcggcggtctcgccgtacgcgatggcgtaggcgggccgggccgcgcccaggacgatcagcatgacgatcgcgagtagcttcagcacagccgtcgatgcttccgggcgggtggtacgggcgtcgtcagcgacgtacttatgcgatctttatcagtgttttggtgtggtgggcaaaagcggggcaacgggaggacgcggcgtgcgggtgttggtcgccgaggacgagcggattctggccgacacgatcgccgaggggctgcggcggttcgcgatggccgtcgacgtggtctacgacggcgacagcgccgtcgaacggctctcggtgaaccggtacgacgtcgccgtcctcgaccgggacctgcccggccgcagcggcgacgacgtgtgccggcacctgaccgcctccgacgccggcacccgggtgctgatgctgaccgccgcggtcggcatccgcgatcgggtcgagggcctggggttgggcgccgacgactatctgaccaagccgttcgccttcgccgaactggtcgcccggctgcaggcgctgtcccggcgcccgtcgaccgcgctgccgccggtgctcgagcaggacggcgtcgtcctcgacatcacccggcacaccgccacccgcgacgggctgctgctgtcgctgaccccgaaggagttcgccgttctgcacgtgctgctgcgcgccggcggccgcctggtcagcgccgaggacctgctcgaacaggcctgggacgagaacgccgacccgttcaccaacacggtccgggtgacgatcatgacgttgcgccgcaagcttggcgacccgccgctgatccacaccgtgccgcgcgccggttaccggctcggcgcgtgaccaccggctcgcccgcccggcggatgctgctcgccggggcggtgctgctggtcaccgcccagttcgtgccctggctgggcgccagattgctggccctggtgtggggtttcgtaccgtggacctgcaccccggaggacacgtcgtacctctgcgtgcagctcttccgccaccccagcattccgcggctgctcagcgaagccctggtgctggccgtgatcatcggcgggtgcgtgccgctgttccgctggtgcctgcgcccgctgcgcgagatggtcccgttgatcgccgacgtcggcccgcagaatctggggcaccggctgcggaccggcgacggcggcggcgacctggcccggctcggccgggcgatcaacgagatgatggaccggatcgcggtcggctacgaggcgcaacgccgcttcgcggcagatgcctcccacgagctgcgtacgccgttggccgtgcaacgcacgctcatcgaggtcagcctcggccagccgctgaccggcgagcagttgtccctgctcaccgcccagctgctgcagaccaacgagcgcaacgagcggctcatcgagggcctgctcgtgctcagcgagagcgaccgcggtctgatgtcccgcaccccgctgcgcctcgacgagatcgtcgccgcggtcgtcgaccgcgttcccgacgacggtctcaccgtcagcacgacgctcgcgccccggatcgtgctcggcgaacaggtcctgctcgaacgcctggtcaccaacctggtgcagaacgccgtcaagtacaaccgccccaacggcaccatcgacatccgggtcggcgaccagccggccctgatcatcgtcaacaccggcgacgacatcccgcccgacgaggtgtcggccctgttcgaaccgttccgccgacgtgccgccgcccgcatcgaccacagcggcggcgccgggctcggcctggccatcgcccgctccatcgtgcgggcccacgacggcaccatcgccgcgtcgtccaccgggcgcgacggcctgcgggtcgaggtgagcttcccggttttcggccggccggtgtccccacggtgatgtcggccggtccgccgcccgtggtcagtcgccgagcagtgccgcgaccagctcctccggcgtctccagctgcggcaggtgaccggagccgggcagcacggtcagggtggactgcgggagcgcggcggcgaacgcctcggcgtgcgccacgtcgacgacccggtcgctggcgccccagatgacgtggaccggcaggtcgagggtccgcagccggtcgagcagggtggggtcgttcatcaccgggccggtgtaggcgaccagcgccaggatgtccgggctggggccggtgcccccggcggccggcggcttgggggcgcgggacgggtcgtgccaggcgtgcgcggccagctcggccggggtcatcgcgccgacgtcggcgaccgggtgcccggcgacctcgatcccgatcgcgttgatcaggaccgcgccgctgacccggggactgcgcagcagcgcgatctcggcggccagccagccgccgaacgagttgcccaccacggtcacgtcggtgaggtcccgctcgtcgagcagcgcgacgtaggcccgggccaggtcgcccaccgagcgcaacccgtcgggctggaccgtgccggcgaagccggggtgggtgggcagcagcacccgcgtcccgggtcgcgcggccagccggccggcgagccccgccatggtggccaccccgccaccgccgtgcagcagcagatacggcttaccggtgccccggtcgtccagaagaatctcggtcatggtgtcgctcccctgtctcgtatacaaggaaccttagataaggaagcttatatacgcaacctgagtttcccgagttaccatccaccggtgccctaccgccccgccgacgtcgccctggccgtcaaacgcctccagcaccgccaccaccgcgccctgaccgcggcactggctccactgggcctgtccctgccccagtgggacaccctgcgccacctgcaccggcacccggacgcctcgctgcacgacctggccgtccgcaccttccagaccgaccagtccttcggctccctggccacccgcatggtcgaccgcggcctgatcgaacgcgtgcccgggccgggccgggccgtcagacaccgcctcaccccggagggcgaacgcctgcgggccgccggccagcagctcgccgacgaggtcgtcgcgacgtccttcgccgccctcacccccacccagctcgacgacctgggcaccctgctccacgctgcactggggtgacctccgtttctgccgccccggcgcggcggcgccgcgtccctgaccccccgggtcaggacacgttgcgtagggcggtgacggcgggctcccgcagcaggtacgggtaggagccggccgtagcccgtcacgagcccacgaccggcgcctcggcgatcaggcgggccgtggagttcacggtggacatgccggccaacgccttgagcaacccagccgacacgagcagcgggaccgcatctatacatctatagacatctatgtaaccaccatttagattgaccctcatgaaacgggtcgcggcttccggtcaggccgaacgcacgtgcaaactcccccgactaccactgccggctgccctgaccgttgcggcgcgctgacccgccttccccaccgagcgatccccgccgactcccggcggcaaggccacgccgtctcccgtcggcggcatcgcgggcccgcaatcccactgaagtcacgcttcaggagtaaaagccgcaattcctctgagatctcatctacctttgcagaatgcagctctccgacctgcctgaactcatctgaactgcgcgtgcatcccccgcgtatctccggccagtcacgatcgccacaacgagcgagcggagttcaccatgtcgcagcccggatcacccgccaaccgagccacctcagacccgctgacggcgaacccgctggataaccagacggaggacggactgcgcgatctcatcgccaaagtcccggccgtcactgtcggcttctgggttgtcaaggtactggccaccactctcggcgagacaggcggcgactcgctgtccatgtccatgcgcctgggctacctggtcagcaccatgatcttcgcggtggtgttcgtggccgccgtcatcctgcaggtccgggcgacacggttccatcaatgggtgtactggttcaccatcgtcgcaaccacgaccctgggcaccacgatcgccgactacgtcgaccggtccctcggactcggctaccctggcggcaccaccatcctggtcatctgtctggcgtgctcctttgccctctggtacaaagccaccggcaccatcgccgtgaccagcattcagaccccgcgcaccgaagcgttctactggctcaccatcctgttctcacaaaccctcggcaccgccctgggcgactggaccgccgacacgatcggcctcgaatacaccggcggcgccctgctgttcaccgctctgctggccatcctcgccgccgcctaccggtggacccggctgtcgcgcaccctgctgttctgggccgccttcgtcctcacccgcccgctcggcgccgtcgtcggtgactttctcgacaaacccatcgccaaaggcggcctcaacctcgaccgctacgccgcctccgccgcgctgctcatcgcgatcgtggcaatcctgttcgcccgacgccaacacccggccacacgcccacactgagacaagtccgagctctctgcagcaccgcccagcgccttgcggagaactaccgacgaggcgctgtgcccgcggcgaccgaaggacgctgtcggacggctcctggctacccgcagcgccgcgagtccgcccccggcggcgagcacctgatgccctgcccggtcgaagatcaacgtcaggatgtcgcggatgtcaggcagccacgttgcggcccgaacaacgtcgccctgcggttgaacggcacgattggtcccgaccacgccgtcgagctccgtcaactccccaccgccggagtctcagcgctccgcattcgtgacgccgctacgtccccactgggaccaccgactccactggccttaggtcgcgatcggccccgcagatggaccatgcgattgtcatcgacgggatccggtggcgggtccggaccggcttaccgtggcgggacgccccctatggatcaaatgatgttgcgcaggcggtgtcggggaacacccgcttcggtcagttcttcggcgattcgtgctgagctgtggtcgaggaacacggcaacctggtgatcatcaccaaggtggcacgcggcagcgagcgtgccgaggttgatcgggtcgagatcgtggacgtcagccaggtccagaatgagacgcagtgggcgggtgcggcggatggcctgcacgagggtgcggctgagtccgacggcgtcggtggcgtcgagagcgccgtgcggatgaatgatgagagtgccgtcggtgctggtgttgacgtcgaccgtggtggtcgtcatcgcgtgaccttccgttaccccggtgttctccgaggtgtcaggataggggtccgacacctgcccgtcgagtgccaagcgggaaagttcacctggtcacggccaggtcatttgcgtagcggtgacggcgaggatagcgacgtaaccgcgcaacgcgaggccgatgccggtcagccggcggttcggtatccgggcggtggagaccggcgtccgcgagtaagacaccagatcgacgacgtctctgagtcaccgaccgacttcgggtcctcaacaggatttgtcggccctggccgggaggtgctcgtgcatttccggagggacctcagggaagcctggcgaggtgttccgcgtcaggatgcggcttccatcgggcaggtgattcgagaaacccctcggcggtctcggtccggatgaacgggtgtggatcactgtttcagccagtgatccacacccggacgtcggccaacgccgccagcccgaccaggaccgggttcccggccggcgggcgacgagtcagatgcctcacgcacgaggtatcggtcatcgggccggcaggcaggctgagctgatccggccgccaccttccgctcagcggagctggcccgcggacaggccgctctggacctgacggtggaagatcaggtaggcggccaggaccgggagcatggcgatggtcatgccggcgaacaggccgctgaagtcgccgcggtaaccctcgctgacggcgagcgcggtcaggccctgggccagcacccaccggctctcggcgccctcgccctgcatcagcacgatcggcagcacgtactggttccattggaagaggaagttgaagatgccgacgctgagcaggccggggcgggccatcggcagcatgatccggaagaacaggccgaggtggccgcagccgtcgaccatcgcggcctcggcgacggcgcccggcagggtgcggaagaacgcggtcaggaagaacaccgtgaacggcagcgaataggcggcgtagaccagggtgagcccgggcagcgtgccgagcaggcccaggtcgcggaccacgaagaagagcggcaccagggcgaggaagaccgggaacatcatgccgccggcgaacgcgtagtaggcgatccgatggccgcggaaccggtagcgggccagcacgtacgccgccatcgcgccgaacagcatggtgatggtcagcgcgccggtcaccaccaccgcgctgttcacgaagtagcggccgaggtgggccgaggtccaggcgcgggtccagttctcccagcgcagccgggacggcgggcgccacgggtcggtgaggatctcggtgtcgctcttgaacgaactgagcaccgcccacagcagcggcagcgtggtcagcaccgcccagcagatcaggaacaggtgcgacaggatcggccggcgcgcgctcacagctccaccgtctcccggcgggtgacccgcaggaacatcgcggccacggtgagggtcaggaagaacatcgccaccccgatcgccgacgcgtagccgaagcggccgtcgccgaacgccgtccggtagagccgcaggccgaccacgtcggacgccgatccggggccgccgtcggtgacgagctgcacgatggcgaatccgtccatcgcgatgatcgccagatacacccaggccacctggatggtgtcccagagcagcggcacggtcagccggaccagggtggtgagccggttcgcgccgtccagcagcgccgcctcgtacaggtcccgcggcacggcctgcatggcggcgctgaacagcaccacgtagaagccgacgttcatccagacgagaacggcgaacacgcaccagaacgcgaaccgcgggtcgccgagccagggcgtggtgaaccgttccaggccgatcgcgcgcagtgttccgttgaccagcccggtgttcggcccgtacatctgtttccacagcacgccgacgatggccacggacagcacctgcggaaagaagtagaccacccgatagaaacccgagccgcgtacgccgtggatcccggcccggtcgccccgtccccccacgctgatcatcgaggcgaagaacagtccgagcgtgatcgtcaccaccggcagcagcacgagcagcagcccgttgtgccgcagcgcggtccagaagtacgcgtcgccgagcagccgccggaaattgtccaggccgacgaagtcgtacgacggtgacagccccgcccagtcggtgccggcgatcgggaacgcctgcgcgtacggcgacaccacgaagacgccgtacagcagcagggacgggatcaggaaggccgcgatgaacggtcgtctgccgcgcatctcagacccgctggtacttcttgacacccggatccgcggcgcattcgtcggcggaccgctggatccggtcgcaccattgggcgccggtgcagcgcccggtcagcaggtcgagggtggccgcgttcacccgttcccgttccagcttgcggtagtaggtggcgtagagccaggtgaacgccgagccccgggacgcgtcgaccatcgcggtgaccgcggtcagcccggcgctgagcggctgccccccggtggcgccggccaccgcggtcaggctgccgacccgggtggtgaaggcggcggcggccgtcctggacagcatgatgcgcaggtattccaggccgccacggacgttcttcgccttcgccgggacgatgaacggttcgctgccggtgccgcggaacgccgtgaacggcatgctgtcggtagcggtgaagctgggggtgggtgccacggtcatcgcgaaatcgggcggtgtcaccgacctcatctcgttctccagccaggatccgcaggagacgaaggcggcccgcccccggcaccattcggtctgcgcctggatgtggtccatgccggcggcgcccggctgcaggaatccgtcgacggccagctggcggtacgcctcggcggcggtccgcaccgcctcgtggcgccaggcgcccggctccaggttgtcgatcgccttgagcacgccgaggccgccgagtttggcggcggccgccaggatcggccagctcatgtatcgggcatgcacccccgggtaggtccacggggcgatgccggccgccttgatccgccggcacagggcgatcatctcgtcccaggtgcgcggatagctccagccgcgcgcctcgaagagcttgcgcgaataccagatcccgtacgccgaataggcgtagttgagggtcaggaacctgccgccgtacgaccccacctcgacgatccccggcagcagggtgtcgcgcacccgcacggtcgggtcgtccaggctgggcgcgtcgagcaggtcggtcaggtcggccagcgcgccctggccgaccagcgcgttgaagtcgatctggctgccgccggagttgtcgaccacgtcgggcgggtcgccggcgacgaaccggggttgcagcgtctcggcgatctgctgggtcgccgagtgccggatccgcgcccgcgggtaccgctgccggtagcgcgcctcgtgctcccgggcgtagtcctcgccgaacccgccgttgaagatcaccacttcgaggggggcgtccgccggcacgccgagcgggttggccgcgctgaccggccgggtcacggtggggtcgccgggcacgtcgccgccgcccagggcgcatccgccgagggcgcccacggcggccaccccggcggcgcaccggagcaggtcgcgcctgctcacgtcgtactccatggtcgtctcctgacttttgtcgatcacggatgggcggcggcgaacgcgtcggccagcgcccggcgggccgcggtgtcggtgccccacgcccggtccggatgcacccggttgctgagcaggatgaggaaggactgacgcaccgggtcgatcaccacggacgtgccggtgaacccggtgtgtccgaaagtgacgggtgacgtcaggccgcccatgtaggtgcgggcggccagctcgaagccgagcccgcggccgccggggttcgcggtgagcgccgcgcggaccatcgccgcggacaggatccggtgcccgtggtactcgccgccgtcgagcagcgtctggcagagcacggcgaggtcgtccacggtggcgaagatcccggcgtgcccggccacgccgcccagcgcccaggcgttctcgtcgtgcacgaccccccggaccagaccacgatggacgtgcggctgatattccgtcgccgcgatccggtgacgcgccgcgcgccccggccggtagccggtgtcgcgcatgccgagcggcccggtcaccccgtcgtgcaccacccggtccaggcgcctgcctgtgacccgttcgaccagcacgccgagcgcgatcatgccgaggtcggagtagacgtactgccggccgggcgtggtccccggggtgaccggcgtgcgcagcgccgcggcgagccgggccgcgggggtcggctcggtggcgtagagcggccggaacgcgggcagcccggaggtgtgggtgagcagctgccggacggtgaccgcggccttgccaccggccgcgaactccggcacgtacgcggcgaccggcgcgtccaggcccacccgcccggcctgcacctgctgcagcaccacgatcgtggtgaacagtttggtgagcgacgccaggtcccagatggtgtccacccgggccgggacgcgccgggcgggcggcagctcggcgatcccggcggcggtcgcggtgtagcggaccgcgtcacccaccgcgaagcgggccaccacgatgccgtggtgcgcggcgagcacggtggcaccggcgtacgacgggtgcccggggtggtcgggtgtcggccgcaggtgggccgccgcgacatcgcgcagttcgccgatcggagcgggtcgcagaccggcctgtgcggcggtgcccgggcgcagcacgtcgtgccggaacgccacgtcggccggggtgaccgcgggcaggccggtgacgagcccgaccgccacgctgagcacgagcctgaccatcgacggcctccgttccccgatccggaaattttcttcgcgacgcgcgcggcgacggaaggttcttgctacccctccgtcactggaataccttcagtgatcatgcgaccgcgtaccgtcactctggacgcttcgcccgtcgttaccgccaccaaccggcgaagtaccacctcggagtgatccctttgctgaaccgacgcgggttcctggccggcacggtcgccctgtccaccggcgccggcgcgtccgccccgccgtcccgcgtcccggtggtgaccggatcggatcggctggcggcggacggctgggcccccctgaaaggccagcggatcggcgtggtggccaacccgaccgccgtcgaccggcggtaccggcacgtggtcgacctgatgcacgcggccgggatcgagatcggcggggtgttcggcccggagcacgggttccgcggctcggcgcaggccggcggcggcgagggcaccggcaccgacgcgcgcaccggactgaccgtgtacgacgcctacgccgccgacccgcagcggtggctggcgatgttccgcgcggccggcgtgcggaccgtcgtcttcgacctgcaggacgtcggggcgcggttctacacctacatctacacgctgtacgactcgatggtcgccgcggcccggctcggtttgcgctacgtcgtgctggaccgtccgaatccgatcggcggacacgcggccggcccgatgatgaccgacggctacacctccggggtcggccggctccggatcgcccagcagcacgggatgaccgtgggcgagctggcccggttctacgacggcgagttcgtccccgccgcggccgggcggccggcccggccggaagtgatcagctgccgcgggtggaccggcgggctccgggccggcgacaccgacctgccgtgggtgctgcccagcccgaacatgcccaccccggacaccgcgctcgtctatcccggcaccggcatggtcgagggcgtcgccgcgctctccgaggggcgcggcaccacccggccgttcgagctgatcggcggccccggcttcggcttccgctggcacgaccgggtggccgcgctggggttgcccggcgtcgcgttccgcgaggcctacttcacgcccacggtcgacaagttcgccggccggctgtgcgcgggggtcgagatcaaggtcatcgacccgcgggcgtacgacccgatccgcaccgccgtgggcatgctgaccgaggcgcgccgggaggccgccttcgcctggcgggtcgacagtggcgcgacgtattggatcgatctgctcaccgggtcgtcccggctgcgcacgatgatcgacgcgggcgcgggcgtcgacgaggtgaccggggcgtgggccggtgagctggccgccttcgaccagcgccggcagccctacctgctctatgcgcgccggtgaggcctgccgccacgccgacggagacaattgacggacagcgccgatcgaaggaaacttttctccatgaccggacgacagggcggcgacaccatcgtggtacgggcccgcggcctgctccccgcgctctcccccgccgagcagcgcgtcgcccgggtgatcgtcgaggaggccgacaccgcggcccggctcaccatcaccggcctggccgagcgggccggcgccagcgagaccacggtcatccggttctgccgggcgatgggcttcaacggatactcccagctgcggctcaccctggccgccgaggccggccgcgcgtccggggcggccggcgacgacgagccggtcggcagcgacatcagccagagcgacgacctcggccaggtggtcaagaagatcgccttcgccgacgcgcgggccgtcgaggagaccgccacccagctcgacctcgccgtcctggagcaggtcgtcgacctgatcgccggggcccgccgggtcgacatctacggggtcggcgcgagcgccttcgtcgccttggacctccagctcaaactgcaccggatcggccgggtggcctacgcgtggagcgacacccacctggccctgaccagtgccgccctgctcgacgagcgggacgtcgcggtcggcatctcgcacaccggcgccaccatcgacaccatcgacgcgttcgccgaggccggccggcacggcgctcgcaccgtcgcgctgaccaacttcccgaaatcgccgatcacccgggtcgccgacctcgtgctgaccaccgcggcccgcgagacgacgttccgctccggcgcgatggccagccggctggcccagctcaccgtcatcgactgcgtgttcgtcggggtcgcccagcgcacctaccagcagaccagggcagctctggacgccacctacaccgccgtccagccgcgccggctgggcgctgaccggaggcactgatgaggcacgtcgaggaagcgtcgctgtcgcgcaccgaggagcgcaacccgcgcagcaccaccatggaccggatgtccacgctcgacctgctgtgcctgatcaacgcggaggaccgcctggtcgcgccggccgtcaccgcggtgctgcccgagctggccgccgcggtcgagctcgcggtcagtgcgctcaccgacggcaaccgggtgcactacttcggcgccggcacctccggacgcatcgccgtgctcgacgccgccgagctcatcccgaccttcggcctggcccccgaccgggtcgtcgcccacctggccggcggcctgccggcactgacccgcccggccgaggacgccgaggacgacgagttcgccggcgccgcggcggccaccgcggtcgtcgccggagacgtcggcgtcggggtcaccgccagcgggagtacgccgtacgtccgcgccgccctggcccaggcgcgcgccgcgggcgcgaagaccgtcctgatctcggcgaacccggcgtcgccgatggccgccgaggtggacgtgcacatcgccccggacaccggtccggaagtgctcaccgggtcgacccggatgaaggccgggaccgcgcagaagatggtgctcaacgccttctccacggccaccatggtgcggctcggccggacctggtccaacctgatgaccgacatgctggccagcaacgccaaactccgcgaccggcagatccggatcctggccgaggcgaccggggtctccccggcctcctgcgagaccgccctgcaggaggccgacggggacgccaaggtcgccctggtcgccctgctcgccgacgtcggcatcgacagcgcggcccgcgccctgaccaccgtggaccgcaacgtccaccgcgccctacgcctgctcctctgaccgcgccgcgccggcagaccagccgcagcggatcgtccaccccgcccgccgaggtacgccaagcgcaccggcccgcagcgaccacacgtccacccaggtgtcaccggcgacggccggcctgtcgccaccctgaccaggccggctgcccgaggcagcagcgcaatccgcgatgcaccggcgcagcgcgcccaccaggtcgtcgcgtcaccgaacgactcgagtcatcccacgatgaccggcgcacgtgtgaggcaccgtgtgaccctggaccgcccgtcgcgcgaccgcggaaccgtaccgggcacccggcgtcacggtgaccgggctgccggccgttccggctcggacgatccgatcaggagcgggcgccgaccgggctcggcgggctagaaggcggcggcgagcaggcggtagtagttggtgccgatcatggtgaggagcagggccagataggcggcgctgaccaggccgtacagcaggtagatgccgcggcgggtggcggagacggcctggtgggcggcggagagcggcatccggaacaggacgtggcccaggtagcggaaggcgcggtcgcgcaggttcagctcgcccatggcggcttccatggcgtggtggccgtcggtgaggggcagcagcgggttgaggttgttcaggacgacgaacagctgcatgcccagcagccagcgcaggtcggcgaagcggtccggcgcggtcagcacgagcagaccggtgagaccggcggcgagcagatcgaccagggggccgatcagggcgaccgcggcgcggccggtgcgggagcgcacccggtaggcgtcggtgcggtcgacgtaggtcatcgggaggagccagaagaacagcttgatcccggcctcccggaccggaacgccgagcgcctggcagacggtggcgtggcccatctcgtggacggcggcctggaccaccagcgcaccgacgatcagcagccacggcgggccgacgaaggacggcggcccgggggcgagcagcgcgagggcgatggccgcggtggccgccgcggcgagcagcagggcggtgctgagcgcgccgcgcgggaagcgggtgagcagccgggccggcgggcgcagcagcaggttgaggtgccgggccgggatccggacgcgcggggtgagccggatcagccagggaaaccagcggcggcggccgcggcgcggttcgggggcgacggtgagcacgccggcggcccgcaggtcggtgaggaacgacagcagggccggggagcggtcgcggacgccgtccgggccacgggagcgggtggccgcgtcgagcagcgcgacgccggtgcggctgccgtcgagcagcgggacgaggcgggcgccggtccggctcagacgcacgtaggtgccggtctcggcgtcgaagagcagcgggttgccgtcggctccgtcgaccaggctgacctggggcgcgaggccgatcggcgcgtccagccaggtggcggggcgaaggtctgcggacatcggtgcctctccggggggtgcgggcggccgggagcgcgcgacggtggcgcgcccccggccgttgactagcctggggtcagcgacatccgccgcaaccaccacagccaccgcagccaccgcagccgtggcagccacggcatccgtgacagccgtggcagccgtgacagccgtggcagccaccgcagggaccgcagggaccgcagggaccgcacggtccgcaggggccgcacggcccgcagccgccacagccgccgcagcccagcagggacgcgctgatcacggtgggcagttgctcggcggtgaggtcgtcctccagccacaggtcgagatcctcggagatctccggcccggtcatttcggtgtgcataacgactcagctccttcgatgtgtcgtgtcatgcgggtcgccggccggcgccctccgccggccggccggggcccgggcgctgccgcgctccggacccacgatcaagatccgccggggtgtccggcggcgaaggcgaacagcgcggcgcggcggtagccgtcggctccggcgagttccttcagtacgtgcggcagcagtccggcgaagaccgacccgaccagtccgagacggatcgcggccagccacgcggcgtgcccggcggcgccggcccgggtgagcaacagccggtgcccgtggctgccgtgccgggcgagcgcggcggccaggttgccggtgagcaccaccacggcggccgccccggcgaactcgcgctgcatgacgagttcctcggcggccgggccctcgggcaggtcggcgacccggatcagggagtcgccggcgggcggatagcggtacagcccggcgggcacgccgtcgacccgccagaccgcgcagtggatctccaggtcgacgccggccgcccgctcaccgggccacgagccggcgtccatcgtgtcggccgcggcgagcagggcgcacagatcggcggcggccatcggcgtacgaccgaaatcccgtgccgccgagcggtccgccagcgtcgcggtgagggtggcacgcggcgcagccggcggcggcagcgtgatcagcggcccgtcagccggcgccgcggccgtctgcgccgggacctcgggcagcgggcggacggccgccgcggcgtccaggcgggtgtcggccagcaggtgttcgagcagccgctggcggtcgtgctgggtggccgtggtcatgacgggtccttccggctcacggcgaccaccgcggtcaccggctcggtcacggcgtcgatccgcagcgccgcgctgatcgcctggtcgtcccagcgatcggcgatccgggtggccagcccggtctcggcggccaccgcggacagctgggcgagcgccgccccggcgtccagacagacaagtcgatatgaaaaatcgtgatattttgccgcgacgaccgggagggcgccggtgagcacgatcagcgccgcgggacggtccgcctccagcgccggggcgatcccggccgacggcccggcgatccgcgccaggctgtggtcgccgcgctggtagaagtaccagccggggtcgagcccgggcacgtcgtcggcccgcaggtaggcctgcaccgagccgaggttcccgccggtcggcgcccaccgggtgacccgctcccccgcgtccttgagaccggcggtgcgcagcagcagcccggccaggtccgcgaacggcgcgtccgcgagcgggatccgcggcgcggaccgatattccttgttgtagcgctgcagcgccgcgttggccggccggaagtgtgcctggtggtccttcgggttgagccactcgcgcggcgggaacgccaccgcctgctcgtagacgtgggccagcgccggctcggccggctcggtgcccggcaggcagcgggggcagccgggccggcggtacgcgccggtgctggtctgcgaccagtcgtccaggtcgtacgcggtgcagccggcggtcgacggagccagcccgacccgggacagcaggtggacgacctcggtcgcggtcagtgcggcccagatcgcggcccgggccggcgacggctccccggccggcgcggtccgtccctcggcgaaacaccggagacagctcgtgtggccggcatcgaacatcggtccgatctcggcggtggacgcgccggccgcggtacgcagccagccgaccccggcccgccggcacgcctcgtcgatcccggcgaggttcccgtcgtcgaccgcgaccacgaaatcgccgtcgcccagactgtcggccgggtggaacgggtgcgcgtcgacgccggccgcggcgagttccgcacgcagcgggccggtgagccgctccggcccggcgatcagcgcccgggtccgggccagccgggccgccgcctcgccgcggctccggttcacccgggtggtgtccaggttgcggcccaggtagtcgaccacctcggcggggatcagctcggcctccccgcccgctgggccgtcctgcagcaggccgctcacgtagagcatcgacacgcacgccgcggcgtgcttctccggcagttcgtccaccgtgcgggtgccgtcgagcaggcgcagcaggcgcgggatcagcgtcatcgcggtccggccgcgcagcacggtctgccggttgccgctgccggcgaacgccaagccgtcctcgagccggacgacgaccaggccggggatcaggcaggggcgccggggcacggtgaactgcgggtcactggcgacggcgtacgccatgtacgcggccgacaaccgcccgtcgttccgggtcgcctcttcggtcccgatcatgccagcactccccgcatcatctccggcagccggtcgtacgaccgggtctgctcgtcacgtcccagaccgcaccgcgggcagccgtgcacgccgaccacccggccggtgcgcagctgctgggtcggcacctcgatctggcggacccggccggcctcgccctccgggtcggtccgtagccgctgcaccacctcggccgcggcggccgcggcgaacagcgcggtcgacggcaggtagccggccggaccggcgtccgggtccagctcgtagtgccggtcgacggccgcgcggacggtgcgggccggatcgtgctgggcgagccgcagccggtaacagccgtggcaggcgccgacgccgggcagcacggccgggccgatctccagcaccgggtggtcgaggatgaccggcagccacgggtcgccggtgcggtgcgcccgctcgtcgaacgcccgctcggtgtccggcacccggcgccaggcggcgagcaggtgcagggtcggccccttgggtgcggcgggcgccgcccggtccaccgggtcggtgatcgagacgtccgggcacaggtcgcgcaggcgttcggcgaccgcgtatccgaacgggcctacgggggaaacgcgcaggtggtacatgctgactcctgatacggtgacatcggccgaacggccagctgctacctcggatgaacggcttacggtgggatcaggcgaacggctgcggccaggcgttgagctcagcctcggagcgggtcgggtgacccatccgggccggcgcctcgtacagccggggcgtgccgaggaagcgcgcacgatagttgaaggacagtggcagcagcccgggcaccaccgcgcggaccaccgtcatcccggcccgtaccgcctcgtccggcgtcaggtcgaccaggtacgcgtcgagaccgcgctcggccaaccggtccagcaccacgcgcaggtcgccgcgcgcgtcgccggtcgacaggtcgggcatctcggagagccggcgccgggccgggctgtccagcaggaagtcgaaggcctcggcgcgctccggagcgcacatgtacgcggcgccgtccgccaccccggtgaaggtgcgcacgtcgtcgctcggcggcctggcgtcgtgcagggcgatccgcaccgacaccgtctcgcagatcgccttggccgccgcgacctgcgggtcgaggctggtcgcgcaggagaccacgatccggcacgacgggtgctccggggccaccgagacgccgtacacggtgggaatccccacgtcggtggtcgcgtcgaacaggtggatcgtcgcgttccgcccggcgcacaggtcgaggtagcgctgcagttccgggccgaccgtgtcgaggaccagccggggcagctccagccgctgcagccaggtcaggctgatcgcgtcgcgttcgaccacctcgcagagcgcgccgctgatcgcccgggccgggtcggggtgcgcggccgcgccggtggagatcgggttggtgatccgttccgcaccgtgcgccgagaagtgcatgtacaccagggcggccggcacccagcacagccgtccggtgcgcgtgttcatgccgcgcacccagcggatcggtgcggaagggtccgggctgaccaccgggcagtccggggcggccagctcggtggccgagcagcgcggcagggtgtccagggcaagcgcctcggcacccagctcgtcggccgtggcccagcggatctgccgctcgtcgtaaaggatgttggcgtatcgttcgagtgcttcggcgatcgccaccacggtggcccgctccgggtcgaccccggtgccggtgccgtccaggctgcccaggcagtccggcccgcacgcgctggagatcacggtggagacgtcgccgaggtccgccgagtgcacccgcagcggcggctccgagggttccaccggcagtggcatgacgtgggtgatcaggccgcccaggggtgacaccagatccttgaggtccattcgccgctgcgccttttcggcagctaccgcactcatcagcgagctcttcccgtgtgtcgatcaacgggcgcgcagaatcgcccggcaccggacaaacgatgtcggcggcgcgtccataactgtggacccgccgccgcggggttcgctgaggtttgcggaaactaacgcccggccagaatgtcctgtccttcgctcggattagcccgatcggccgacatttccctcaccgccggtagatgaagattgaattgccgacgttgtcgatccgggtgctcgtcgcgagcagttcattgaagttcgcccgagcctttttcgcactgatcacggaggcgtcgggcaggcaggcgctcttcagcgtcaggcaccgcaccgagatcgcgatcagcccgtgcacctgagccgggggcaggaccagcgggttctgcccgggcacgccgtaataggcggcccggccccggcccttgtagatcagccaggcctgctcccccggatatctgcgggccagccggtcaccgagccgggacatgtcctggccccagtcgacattcgagtcggtaagctgaagatatgtcttggacgggccgccgaaggcctcgttggaatatgtcagataatacggaaaggcggccagcgaactgatcgcgacgaacgccgccagcagacccacgacgacccgcggccaccgattccggtagaccagcacggcggccgccacgaccgccaaaatcaccgggacgaaaatggcgtaccgcacgccccagttccggttgccggccatcgccgtcgcggtcagcaccgcggtcggcagcagcaggtagagggcggccggccgcagcttcgccgagcgcagcatcgcgaccgagccgatcagccagagcgccagcatgcccagcggttccttgatcagcagcgcgcccggcaggtagtaccatcgcgcgccgttctggaagtcaccgaacagcacgctggagtaggtgcccttctccaggcccagctgcaggcgcatcccgtcgaggaacggccgcggcaacggcaggaggttaaacagctcgcccttgagcccgtgcaccgggcccaccgaccggggggtcacccagtgcaggtgcgggtcgacgatcaggtaggtaacccacacggtggcgatcgcgacggcgacgaccccggcggccgcggcgacgccgatcagcagcagccggagcaccggtgggcggcccaggtgatgggcgcggccggcaaaccacaccgagacgaccgccagcccggcgccgacgagcagacccggcagggcggtggccttgctggcggtcgcggcgcccagggcgacaccggcgagcggaaggtgaagatacggccgggaccgggcccgccacaacagccacagggcggtcagcaggaagccggcggtcggcaggtccaccccggccagcgagccgtaaccgatgacgtccggtgagaacgcgtacagcagcagcgccagcaggccgccggccgggccggtcaggtcccgggcgaaggcgaagaccaccagcccgaacagcagggtcaggatgatcatcggaagccgggccgcgaagagcagctcctgcgcgtcgttgccgctgtcgtacagcaggtgctcgcccagcgcccactggtcgccgtcgaagtgcgtggtgcgcttcacgtcgacgaaggccagaccggtggcctccagcagcttcgtcagcggcggatgctcgtagttgtcggccaggtcgtgatcgtgcgcatacgtcaccgcggcgccgagataggccacctcgtcgaccgtggtggactcctgccgggcggcggtcaccatgccgacggccatctgggccaggaaggcgacgaccgcgagcgggaccagccaggaccggtggcgggaccacaggtcggccggcccgcgggtgaccgcgacgggtgctgccgcggcggtgacatcctccggggtggaaacatcatcgacgtccgaggtcactgaggctcaacccttcgccggtggaggaaacgcactgccaaatgacgagcgccatgatggcacgaacattccgtgccggagcggcccgggttatgtgacccattcagactaggcccgaataacacggtggaaatagccttcacaccggggtgtaatcgccgtcccatcaattactactttttccggaaatttcgggcgccagtgtgtcgggtggcggtggcggcgccgaccggataggttgggggcatgatcagggacctggtgcgccgctccctgatcctgctgctggccgcgctgggcgcatgccgccgcgtgccgccctcccctgtggaccttccggtcgtcgccaccgtcccggtggccgaccgcacccgggtgctgaacgcgcagaccaccgtgtccgccggcgcctcccgcgcgcccccggctttcgctgtctgatcttttccggctccattccggccccgccgcttccgcgtttcggccgatttccatccagcttttgccagcttttcatcagtcttccgtcagctttcccggaggaacaatgctgctcgccgactccatcgcctccgtcgcgatctggctggttctgctgctgttcgccctgcccgccctgctcctgctggccaacccgcaggcggtgcgccacccccgcgagttcgccctggaggcgctcggcctggcccgctcacggcgggaggccgccgaactcgcccggtacgccgaggagatccaggtcgccgccgaccgcgccgaccacgccgcacagcgctggcaggagcaccggcagcgggccgagacgcacgccgccgacacctggcacgcctggcaggccgccgagcagcgtctcacccgggcccgcgccgcggccgccttcgccccgccggacagtccgcgcaccgccgccgaatacgccgaccgggaacgcttcctgcaccgctcggtgcgcgccgccgtcgaccgcggagacctgccgtccgccgcgctgcccgccgcgatcgccggacgcgacggctggaacccgcgcctgcacccggccgaccaggaactgatcctgctcaccgcggtcaccgcccaccgccgcacgatccaccggcaggccaccgtcgccgaacggaccgcggcgcacgacgcccggctcgccgccgccacccggcacagcctgcgtcgcgaggcggccaccctgcgccgcttcctgccggccccggagcggcgcaccgccccgtccctcgcccgcgcctgggttcagcgcaccgcctgaccggcgcacgcccggcttcggtgacggtggcggagatcaggcgaggccggcgtcgtgggccagcagcgcgatctgggtgcggttgtccagatcgagcttggtcaggatgtgcgagacgtgggttttcacggtggccagggtcatgtccagcgcggcggcgatctccgtgttggaccgaccccggccgatcgccaccaccacgtcccgttcccgcgggctcagcgccgccagcgtgttccgggcccgcgcatacgctccggcctgcaccgccacccgatccatcaaccgccgggtgatccccggcgacaggatcggctccccggccgccacctgccgcaccgcctcggcgatccgcgccggcggcgtgtccttgagcaggaacccgctggccccggcgcgcagcgcgtgcaggatgtcgtcgtcggtgtcgaaggtcgtcagcacgatcacctcgggcgcccgcggccggccgcgcacccgccgggtcgccgtgatcccgtccacccgcggcatccgcagatccatcagcaccacatccggcgcgtgcgcgtccaccaccgccgccacctcgtcgccgtccgcggcctcccccaccaccgcgatccccggcgcgccatcgagcatcatcgtcagcccggcccgcaccagcgcatcatcatccaccacgatcacccgcaccggccgcgtcatgccggccatgctaacgacgcccgcggaccactgtcggggagaccgtcagcggccggaaggcggccggtccggtgcctgtctgacgcggcacaccaccgtctgtcaccggcgcgacggtcaccggggccagggcagggtagcgtacaggtggaattcgccggcggtggactcgtggtcgaggtggccgccggccaggtggacgcgttcggtgaggccgaccaggccggcgccgccgctccagccgggtggggtggggtggtcgggggccagctcgttgcggacgtcgatgagcaggcccgcgccgggaccgccgcgcagctcgacgcggaccgcgcggcccgcggcgtgtttgcgggcgttggtcagagcttcctggatcacccggtacgccgtgcgggccaccgcgggcggcgcctgacccggctcggcgaccgtgtcgcgcagccgcacctcggtgccggccgcccggctctcctcgaccagtcgcggcacgtcggccaggaccggctgcggccggctgccgtcgtcgtccgccggggtgtcgtcgcgcagcagcgagatcacctcgcgcagctcctccaacgcctggtggacgccgtcgcggaccaccccggcggccgccgcgacgcgctccggcggtgcgtcgggccggaactccatcgccccggcgaaggtggcgatcagcgacagccggtgcgccagcacgtcgtgcatctcccgggcgatcttgcggcgttccagcatccgcgcctcggcgacccggcggccctgttcggcctcggcgcgccgggcccgctcgcgcagggaccggacgagttcgtcgcgggcccgccaccaggcgccccagccgagcagcgcgccgtagccgacggtgaccagggccagccaccagccgtacgacatcccgtcgttgggccgccaccagccctgcaccgcgtgcgccacgacgccggccgccgcgcccgcgagcccgaccgggaaccggtgccgccgggccacgtgcagcgcgacgatcgtggccggtgggctggccgccggggagagcgcggccagcacggcgagcacgccggcgaccggcaccggccgccacagcatgagcggggtgatcagacaggcgagcacgccggccaccacgtccagggtgagcagcggggcgaccatcgggcgcccggcccaccaaccggtgacggtcgcggtgaccagggcgccggacaccccgaggaccatgccgacggcaccgttggttttcacgcggtcaccgtatcggcggcgctgccggcgccgacaccgaccaaagtaggagaggctgcaacttaggagagcggcgccgccgacttcggtccgatgtgggcgaccggccgggtcggccaggctcatcggcatgacgaaccagacgcaccgtcccgccaccgccaccgacgccgactgcccccgtcccgcccggcgccgcgccggccgggcgatcaccgtcgccgccggcgcggccggagccctgctcctgtggacggtcaccgacccgtggggcggcaccgacctcaccgtccgctcaagcgggggcacgacccacatcggcccggccgccgtcgtgatcaccgcgctgctggccggcctggccgcctgggcgctgctcaccgtcctggagcgccggacccggcacgccacccggacgtaccggatcatcgccttcgtggtgttgctgctgtcgctggccggcccgctcggcagcgcggtcggcgccaccggcacgctcaccctgatcggcatgcacaccaccgtcggcctggccctgatcctcggcctgcccggccgccgcggctgctgaccggtgaagccgtgggcgacggtggcgacgcgggcgcatacgatccggcgatgcgacttctggtgatcggtggcagcgggttgctcggccgggaggtcgtccggcaggcccggctggccgggcaccgggtgacggcgaccgcgttccgccggccgaccggtccgcggctggacatccgggaccggtccgcggtcgccgctctggtcgcggccgataatccggaggtggtcgtcaacgccgcctatctgcagtcggattgggcgaccaccgctgacggcggcatgcacgtggcggcggccgccgccggctgcggcgcccggctcgtgcatgtctccagcgacgccgtcttctccggccgcgcgccgtcctatgccgagaccgcggcgcccgacccggtcaccccgtacggcgcggccaaggccgctgccgaggtcgcggtccgcggcctggtgccggccgctgccgtggtgcgtacgtcgttgatcatcggcgccggtgattcggtgaccgagcggcacgtccgcgatctggccaccggccggcggtccggggtcctgttcaccgatgacgtccgctgcccgatccacgtcaccgacctggcggccgccctgctggagttcgccgcccgtccgtcgcccggcgtgcatcacgtggcgggcgccgaggcggtcagccggcaccggctgggggtgctgatcgcccgccgtgacggtctcgacgagtcggcgctgcggaccgcccggcgggtcggcagcggcctgcccggtgccgtcgacgtacggttagattgtcgtgcgacgcagcgccggctggtgacccgcctgcgcggggccggtgagtttctgtcgctctgacagcgggggccgcagcaccagcaccgcgacgaccgccaccatgatcactgcggtgagcaggaccgggaccccggtgatcgggtcgagcaggacgagcagcgcgccgagcgggacggcgaggtcgtcgctcagcgcgtggtgcagctctcccgccgcgatgctgaccgcgaccacgaacaccaggtcgaagaagagttccaggggtgtcgcggtgcgtcctggttcgcccggatcgcggggtcgcatcggggtgagtcggaaggatgtcgccgcggtcaccgcggcagcgtaaccggtggccccccggcgctcgttacatccgtagacccgccgctttatcccatccgcgaccgaaaagtgcgggttccggccgccgtcatcctcagggaagtccgacttcgtgcatccacagccgccacgccgcaccactcacgcccacggaacaccgcacaaccggctcgtctacgaccgctgggggcggttcggccgcccggtggtcctgctgcacgggctgttctacgaccggacgatgtggtggccggtcgccgccgaactggacgcgggctgcgccgcggtcgcggtcgacctgcccggacacggcgagtccgcgccgcgcgccgacctcagccggctcaccgaggacctggccgcgctgatccgcgggctggacctgcaccgcgccccgatcctggtggcgcacgccggggcggcgcggctggcccgggccttcgcggagaagtacgcggtgcagcacgtgctgacggtggacgacgggacggacaccgacctgtcggtggtgccggccgcgtaccggcagttcgccgttccccggcgaccggatcgggcggtgaccgccgcctaccgcgagtgggcggcggtgccggtcggcgccggtcacccggcgagccgggccgagggcacgttcccgcacctgcgggatccggcggctttcgccgccctgctgcacaacctcgtttagccgggccacccgggagccagcgccgcgagccggttctccagcccgaacgcgatgtagggcggcggcggttcccaccggatgccgtccggcgcatcgatcagtgcggcctccacgagcgcgaccgcgcgcggatcgccggccatcgccggggacagcgccgcgcacgtgcggatcagccggtccgggtcgtcgagcagcaccccggtgtcgacgcccgccccggccagcccgaggacactgtcgacccgcacgtcgcgacagccgtcgccggtggcgatctcgcgcaggcgggcgatgaccggctccggcacgggcgggccgagcgccgcccagcaggccgccgcgtaccgggcccggccgcgttcgtgcggatcgtcggcgtccagccacggcgtgagcgcggccagcaccgccggcgcccgacgcacgcaggccgcctggaccgggccggcgatcaggatggccgggtcgccctcgaagtcgtcccacacctcggggaaggcggcggcctccggatcgtcgcgccggatcgccagcatcgtgctctccgactcggacgcatatccgccgcaccacgcgccgacctcgccgagcagcgccagcagcgacgcccgcatcgaccggccggcatccgggtccggtacgcccagccggtcgtcggccaggatcccggcgaccgcctccaccatcgggccggtcgccggatggatggtctggcggtggcagacctcgtggtacaggtgccgcagcgcccgggcccgcgccgccggctcgacggcggtcaggtcgcgcaggtgtcccggggtggcgaccgccgggccgtacgcgtgcgtcgtgcgcccccaatcaagatccacgctggtgagagtagtgagcggcccgatcctcgtcgagcagcaggcggcgtagccggcccagagcacgtgcccgggtcggcccgatcgcgccgaccgggatgtccagccgggcgctgatctcggtgtaccgcgcgtccgggtcggtcgccatctgccacagcaggcggcgctggcgctccggcaggcgggccagggcgcggcggaccgtggcggcctgctcggcgcgcagcaggtccgcctccggcgcctcaccgggctgggtcagccactcgtcgaggccggtcaccgggcattcccggtcccggccggcgaccgcgtgcaggcagaaccgccgcatggtgacggccagccaggcgccgaccgcctccgggcactgcagccggccgatcccgttgaacagttgcagccacgtcgcctggaccaggtcgccggcctggtcgggcgggatccggaaccgccgggcgatcatccgcagtcgcgggtcgtaggcttcgacgagccggctccacgcccgctcgtcaccggcccgagcctcgcggaccaccgtggcaagatcctccgccaccgcctgtcgcatagccgtctccccccacctcgcgccggtcgccggccgggcacgaccgccggtcgccgactcctgaagcctgccgacggtcgcggctgtttcgcgccggggaaatccccggtgtcatgcgatcgggtgagttccggcgctccaccggggggcattcattcatccggccgcccgggccggtcccgaacaccggcgacccgagtaggggcaggcagagcagcgccagccccaggtcggtgcagatcagcgtctgcacgctggtcagcccaccgagcagctgctcggacaccatgctcatcaccacgttgttgccggaatgggcgaggctggtcacccacaccgagccgctacccgcgtacagccagccgagcagcacctcgaagagcaggaacatgacggtccacagtggaatgctgaccgcccggtcggtgaagtcggcgtagccgagaaaggccagcggatagtgccagaacgcccagatcaggccggtggccagcagcgacagccggggccggccgggcaccaggcgcggccagaggaagctggtccagccgaactcttcgccgaaataggccgggatgagcaccacctggacggcgagcagcatcggcaccccgccgggcccgccggccggccccacgccggaccgccaccagccggccgagtacgcgcagcccagcatgaccgcggtggcggcgagcggggccaaccagccggccgcccacaaccgccacggcgcgcgcaggcgcaacccggcggtggcgaaaccctcccgggtgacccagcggcgcaccacggccgcgccgatcgccggcacgaacgccaccggcagctggaccagcggatcgaccagcgaccagccgaagccgagccggaccacgaacaggtacggccacaccccgccgaaggcgatggccagatagacgacgattcctctaccccgtgacgacatgccggaaagtcgatcatcagccgccctgcggggtcactatcgatggccaccgtcctgcggtatgcccagctacacccgggcggctctgaaacaagtcagaaagattgttccggaaccattaagggagtcttaaagaacattgaggaccgtccggcgtacggaaatcctgtccccgtctcccccgacggaaggtccccaccatgcccctgtcccgcagaagctggctcgccgccggcacgatgaccgtggtggtcgccggcctcggcgtcgccggcatcaccgaggcgctggccgccagcagcggcaccctcgtcagctcggccaacggcagatgcctcgacgtcaccgacggcagtaccgcgaacggcaaccagccgcagatgtggcgttgttccggcggcccgaaccagaactggacgctggccgacaacggtcaggtgcgggcgctcggcaaatgtctcgacgtggcgaacaacgccaccgccaacggcgcggtggtgcacctgtgggactgctatgactcggtggccacccagaaatggacgctgaccgcctcgaaggacctggtcaacctcgcggcgaacaggtgcctcgacatcaaggacggcaatctcgccgacggcgccaagctgcagctctgggactgctccggcggcgcccaccagaagtggacgttctccggcagcggcaccacgcccccgaccaccgtgccgaccgacccggcgaacccggacctcggtcccaacgtcacgatcttcgacccgtcgatgcccgcctcgaccatccagagcaagctgaacgcggtcttcaacggccaggtcagtaatcagttcggcaacgctcgccatgcgctgctgttcaagccgggcgtctacccggtcgacgcgaacgtcgggttcttcacccaggtggccgggctcggcctgaccccggaccaggtgaccatcaacggccacgtgcacgccgaggcggactggtggccggacggctcacagaacgccacgcagaacttctggcggtccgccgagggcttgtcggtcagcccggcggacgggctggaccgctgggcggtgtcgcaggccgcgccgtaccggagaatgcacgtacgcggcaatcttgcgctctccgacgggggctggtcgtcaggtgggttcatcgccgactcgaagatcgacggtcagatccagtcgggcacccagcagcagttcctgacccgcaactcggcgatgggcagctggtccggctcgaactggaaccaggtgttcgtcggctcgccgggcgcacccgcgcagagcttcccgtccccgccgttcaccaccgtcggctcggcgccggccatcgccgagaagccgtacctgtacgtcgacagcgccggcgcctaccaggtcttcgttcccgccgtgcggaccaacgcgtccggccccacctgggcgaacggcacgcccgccggcacctcgctgccgatcggcggcttctacgtggtgaagtccggtgacaccgcggcgaccatcaacgcggccctggccgcgggcaggaacctgctggtcacgccgggcgtctaccacctcaaccagacgctgaacgtgacccgggccggcaccgtggtcctcggcctggggctggccaccttcgtgccggacggcggcgtcgacgcgatgcacgtcgccgacgtcgacgcggtgcgggtcgccgggctgctcttcgacgccggcaccaccaactcggccatcctgctgcaggtcggcccgaccggctcgaccgccacgcacgcggcgaacccgaccgtgctctccgacgtgttcgtccggatcggcggcgcgatcgccggcaaggccaccgtcagcgtccagatcaacagcaacgacgtgatcggcgaccacgcctggatctggcgcgccgaccacggcaacagcggcacggtcggctggaccaccaacaccgcccgcaacggcctggtggtcaacgggaacaacgtcaccttctacggcctgttcgtcgagcactaccagcagtaccagacgatctggaacggcaacggcggccggacgtacttctaccagaacgagatgccgtacgacccgccgaaccaggccgcctacctgaacggcgccacccggggctgggccgcctacaaggtggccgacacggtgaccagccacgaggcgtgggggctgggcagctactgctacttcgccgtgaacccgtcggtggtcaacgcccgcgccttcgaggcccccgcggtcagcggcgtcaagttccacgacatggtcaccgtctcgctcggcggcaccggcacgatcagccacgtcatcaacaacaccggcgcggccgcgaacagcggccaccaggtcaccgacctgaccagcggcccgtagctccggcaaccggacagcgacccgacaaccaccggccggcaatcaccggaaccgggcaggcgacgaagagaacggtgagcccggcgccacgccgggcgccacctctcgaaagggtccacgtcttgcgctctctcctccgcagcttcgccctggccgccctcgtcgtcccggccgcggccggcgtcatgatgaccgcgtccccggcccaggccgcgccggcgaaggccaaggcggccgagcaggccctgcaggccgacatcaaccggctgatcaacgagcagcgggtgcagcacgggtgcggcgagctgaccgagaacgccgcgctcacccaggcggcccgcgcgcacagcgcgtggatggggcagaccggcgagttctcgcacaccggccggggcggctccaacttcgtggcccgcgaccgggccgccgggtacgcccgcccgtcggcggagaacatcgcctggggctaccggaccgccgacgacgtggtcaccgcgtggatgcacagcccgggccaccgcgccaacatcctgaactgccggtcgaagacggtcggcctgggcgcggtgtacgccgcggacggcaccccgtactacaccgaggacttcggttactgaccacgaacgccggccccgtcgctcttcgcggcggggccggcgtcgtcgtcggctcagaagatcggccccaggttggcgaccgtgaacaggtggtcctcggcgacctggtcggccggcggcgcggtgacccggaccggcaggccgtagtcggcgtagctcacggtcatcgccgggtcggtcagggtgatccggctgaaccggccggccacgtccagctcggcggtgcccccacccagccggaagcggccggaggcgcccggggcggcgcccggttgaccggccagcgtccgggccgcggcccacgggaagccctcggcgaaggccggggcggcatccgtcgggaccgtggtgtgcacccaccggcccaggtcgtcggcatactggccgggatacatgctgtgcgccggctcggcggtcagccggacgtagacggccggcccgatccggcgtacgacatagccgtccccggtcatctcccagttgccggtggccgggtcgatcaccccggtggcccgctcggcggcgcccagggtgacggtgaagcgggccgtctcggtgcccagccgggtggccgcctgcgccagggtgggcgcggcaccggacggggtgggagcgggcacggactgggcggacgcgtgggccgagcagccggccgccgcgagaaccccggccagcagcaggcttccggcgacgagccgtcgtgagtgatcatgcacggcggcaactataagggtcagtcgagtcccaggcggccgaccagccggtcgctgatccactccaggtggacggtgaagttcgcctcgctggtcgcgcgggcgctcaccacgccggcgtcgacggtgaccctgacgccgaagtcgacggcgatccggtccggcgggtcgcgaatggcgcgccggctgtcccggatcgtccggcaccgatcatcgtcgatgaccgccggccgcggcagcccggcgcggtgacgcatatcccactcgacccataggttgaatcgaatatggtgaccgcgtgcggaaccggtcgaacgctcccctggtcgtctacctctgcgccgccttcaccacgctgctcgaccaggccagcctgaccaccgcgctgccggcgctgcggggcacgctcggcgccgggccggccaccctgcagtggatcatcgcggggtactcgctgaccttcggcctcgctctggtcccggccgggcgcctgggcgacgcgcacggccgccgccggttgttcgccggcggggtcgccctgttcaccatggcggcgatcgtcggcggcacggccaccgcgccgtgggtggtcgcgatcgcccgcctggcgcagggcgccggcgcgggcaccgtcaatccgcaggtgtacggcatcatccaggacctgtacacgggccgggcgcgcacccgggcactcggcgcctacgccaccgtcggcgggatcgccggggtgatcgggccaccactgggcgggctggtgctcaacgcggccggggagcacctcgggtggcggctcatcctgctcttcaccgtgccgttcgggctgacgaccgtaccgctggcaatcctcctgctgccccgcggccgcgcgccgcaagcggcccggaccaccctcgacctgcccggtctcggcctgctcgcggtgaccactctcggtctgctgctgccgttcaccctgcccgccggaagcggtccgccgcgcgcggtgtgggcgctcgccgccggcgcggcgctgctcgcgctgatcgcctgggagcgccggtacgcgcgtcgcggtcgcaccccggtgctcatccccgatctgctgcgccggcccggcttcagtctgggcacgctgaccgcgatgttccagttcggtgcgtcgctggcgaccaccctggtactcgtcctccacctgcaggacggtctcggctggtcgccgctgcgcgccgcgctgaccacgctgcccagcgcgctgggtttcgcggtggcctcggcgcagagctggcgcctggtcacccggtacggccggcccagcgtgaccgccgccctgaccggggccggccctgtcgatcgcggccaccatcctggtgctgcacaccctgtccggcgccgcgctgggcgtcgcactggccggcacccaactggccatgggcgtcaccggcgggctggtcgtctcgccgaaccaggcgctcaccctggccggcgcgcccgccgcggtggccgggctggccggggcgttcctgcaggtctcgcagcggatctcggccacgttcgcgaccgccgcggtgaccggcgtgctgagcggccgcaccgggctcctgctgtgcctggccatgatggccgccggggccgggatgtccgccctcgacagtcgcccgcctgtgacgcaggcaaccaccgccaaatctctatctaagctataggctttgcagggaaatcgccgtacgggaggttcgatggctcaccgacaaccgcatctggcgctggagctcggcgcgaccgccggcccggagcacgtggccgccgccgaggccgccggattcgccctcgtcaccatcgacgacacgcccggcgccgcacagcccgaagccggggtgcgggccgcctacctggcccggcgcacccggcggatcgcgctcgcgcccaccctgcacgccaccgtcaccgagccgttccacctggccacccagctggcctcactggaccacgcgtcgctcgggcgcggcgcctgggtggtcggcgcggcggccgggcccgcggcgtacgcgacggtcggcctccccctcctcgacggcgccgccctgcgccgggagatcgccgacgtgatcgacgtggcccgccggctgtgggactcctgggaggacgacgcgatcatccgcgacgtgcccagcggacgcttcctcgacgccgaccgggtgcaccacgtgaacttcaccggcgaacgcttctccgtggtcgggccgctgatcacgccgcggccgccgcagggccagctggtcgtgctcggcgccgacacgctcggcgtcaccgaccggctcgacatcgcgctgatcccgttcgacaccgtcgacgcgctctccgcccgggccgggcaggcccggacggacggcgcgccgctggtcttcgccgacctcgacctcgccgtcgccggcgacgacccggccgggctgatcgaccggctgggccgggtcgtcgacggggtccggctgcacctcggcgacatcgacgccgacctgccccggatcgccgcgacgctgtcccggcccccggtcaccgggccgaccctgcgcgacaccctcggcctgccccggcccgtcaaccagttcgcctaggaggttcacgtgctgcacctgggagtcttcttcaccggtgtcgggccgcaactgctgtggaccgatccggcgttcagctcgcacacccacatcgactcgttcatcgccacggcgcggaccctggagcgcgggctgttcgacgccttcttcctcggtgagggcctgcgcgtccgggagaaccgcggacgcgtccacgacctggacgtcgccgggcggccggacgccatcacccagctcgccgccctggccgccgaaaccacccggatcggcctggtcgccacccagaacaccacctacaacttcccggccgacctggcccgccggctcgcctcgctggacgcgatctccggcggccgggccggctggaacatcgtcaccaccgacaacgcgtggaccggggagaatttccggtacggcggatggctgccgcacgagcgccgctacgagcgggccgccgcgttcgtcgagaccgccaaggcgctgtggcgcggcgagaccgtcgaccggcacgacgacctgatcgacgtgaccgccggcccgaccgtcccggcgtccccggtgctgttccaggccggcgactccgcgggcggccgggacctggccgcccggcacgccgaggtggtcttctccgccaacaccgacttcgacaaggccgtcgattacgccaccgacctgcgccggcggctcgccggtcacggccgcccggcggacgccgtccggatcctgccgggcgcctcggtggtgctcggcgacaccccggccgaggccgaggagaaggcccgctggatcgcccgtgagcaggtcaccggcccgcgcgcgctggccttcctggaacagtactggggcaaggacctcagcggctacgacccggagggcccgctgcccgacatcgaacccgccgagggcgaactcgacccgtcccgcggcaccatctccatcgagcaccgcaccggcaaggccgaacgcatcgcgggctggcggcggctggccgaggaccgcggctactccatccgcgacctggtgatcgaggtgaccccgcggcacagcaccttcgtcggcacgcccggccagatcgccgaccggtgggcgcgatacgacgaggcccgggcggtggacggcttcaacatcctgccgcagctgctgcccggcacgatcgaggacatcgtcgaccggctggtgccggagctgcagagccggggcatctaccgcaccgagtacaccggcacgaccctgcgcgaacacctggagctgccgccggcctgagaccagcgggcgttctctgctgcgatcgtgtcacagaagccggcgcggccatccgcggctcaccttcgaaggcggagagcgaatggccgcactcgacatcgatgccggttagtcgatcagaagcgacttagccgagcaccagggacgcattcggaagagtgttgacgatagtcctcatgctggtgatccatccgcctcggaagcaaggaagcaccatgtacctctccgaaatggaaaacgcgggaagctcgtaccggccgtcgcccttctgaaccataccgacagcgagcacatccgaggtgttccgaggggtgagcatcggtccaccgctgtcacccttgcaggcgaagacgtcaccgaacacatagattgcgctgaagttggcgccgcccggatagttgtcgctgatcatgtcgctctcctcgacccggaggccgcagtgcacccccgactcggctccgctgctacaaatcctgtccccgatgctcacgtcaccgtatccgatgaccttcttgtcgtagccagccgagttgtcccaagcgccgtcaaacacacgcccggaccccttggcgctcatttgacgagcggcaccgtcaccggagttccgtactccatccccgtaggaacggcttccggaaagggtctgataatggtggtccacgcaatgccgggccgtcgtgacgtacggagatccgttgacgttcaccgagaagcccgtcgagcaggtgtcgttgccttgaaccatgagcccgcccgcattgaagggcgaatagtcactccaccgctggccgtccaggttgacagatgcgccggcttcaaccattgcgggaacgtcggtcaaggcagcaatgcgccgagaaagtgcagatgcggcatccgagtcgagagcgttggggatgctcttgccttttatgtttgctccggtcgcgcccttcactacgataccgtcgaacttcggattgaccgtcgaaatcgctgaccactggaagccgcccatcccatccctaccttgggccatcaccttggcggccgcctggtcgagctgggctctactgaatttgcggcgctcgaacgtgacggtaatcccccgacgcttcccctcggcagctatcgacttctggagggcggtctcgtctccactccagagcagggtcgtagaaagattcgaagagtcgtttatcgactcgatgtagccgctgtcggcgagctccggcaggccgataagccagcttttgaagtccatgagccggtcctggttgggatcgatggacgagtcaaggatgtcctttgcccccgcgggagcgaggtgaccatgggcttcggccggcgacacggcgagggccgatagtaataaagtggacactacggtgccgaacgtgaccatcttcttccgcttgagcaaggatgcctccctctccccccgcgagcagctccccatgaagggcaccccgcgatccccgttcactgacccccaccttccgcatgggcgatggggagcccgaacgctagctagctagcacgatcggtgtacttctatgtgcttatgattcaggagcgtcgatggccgcgctctttcggctgcggatggttcgccgagtaacgccgggcgaaccttgcgtcgacgacgcagaccacccacaccgcaccggcgccatgtcgtcgttgcaccgctcggcaccacatgcggccgatcgtggtcctcgagccagacccgcaacgactcgactgcccgtacgtctcggcacattggggcggcgaacgagtcgatcgccgcctcagtggactcgtctgcagagcaagggacgccgaactgctgctcataccacaagtgcacgcgcgattcgttgcggatctcgacgtcggcggccagcccatcacaagaccgcccgggttcacgcgcaggctgaccgctcgccggccggtcccgggcctcggcggggccggggtggaggctcggctcagacgggatgctcgaccggcggaccggccggtggcgcggccggttgccgcgccggctcggcgaagctggacaggctcagcgcgccggccacggccaggacgaaaccgaggacggcggggaccgcccagcccgggcgggtgcggtcgtgccacagcaggatgccgatcgcggcgggcaacgcggtctccccgatcacggcgagcgcggcgaccgcggtgaccgagccgcgttgcaggccggccgcgaaggaggcgaacgcgcagacgccgcagatcgccgcggcgtaggcggccgggtcgtgcagcagtgccgccggctgcagcgacggcaccgcgcgcacggccagcgcggtcagcccgaagccgaggccggcgaccgcaccctgcaccaccgggccggccggcgcgcgcaggcgggtggccagcggtgtgatcgcggccagcagcagggcggcggcgagcagcacgaggcgggtgcgggtgccgaccacggtggagccctccgcgccgctggacgccccgagcagcgccagtccggcgcagacggcgaacaccgccgaccactgccgggcgttcaggcggatgcccagcagcggcacgcacgcgacggcggtgacggccaggttgccggcctgcgccgcctgcaccacgaacagcggccggtagcgcagggccagcaactgggcgccgaagccggccaggtcgagcaggatgccgagcaggaacggggcgcgccggagcatgccgagcatggatccggtggcggcggcgcgggcctgcagcgcggtcgccacgccgtaacagagggcgcagagcacggcggcgaccatgcgccgatgctacccgccggccggggccgccgcgcgcagccgctcgcggaccgtcatcagggcgaagccgagcaggttcaggccgcgccaccgggccgggtcggcggcgcgcgggtcgtcgcgggtcaggccgatgccccagatccggtccgtcgggctggcctcgaccagcacgcggtcaccggtgccgagcaggaacgcggccaggtcgggatgctggccgaacttggcgaggttgccgcgggtgacgatgtcggtgcggcgggcccgccaggtcggctcgtcgaacggggtgacccggccgcccagcagtttcgcgtcgcgcgggtggccggcggcgaggatccgctcggccgcggcggtgtccccgaacaggaccgccttgctccacatcatgtagtgctcggcggtcgcataccggatcccgtcgacggtgcagccctcgggcgaccactggctgaggcaggtggcgctcaccgacccgtcccgtgccggtgtgtgtccccagaaatacaggtacttcgggtgccggccggcggccagggcggtgagcagggacgggacgtcggagatcatgccggccagtctgcggcatccccattccgggcgaaaggcattaagatcttcgtgaatcgcctggccggtgtggaaggggacatatcgtgggggacaggatcgacacgtccgtcgcacatccggcccggcgctacgatttcctgctcggcggcaaggacaacttcgaggccgaccggcagtccgccctggagatcgagcgccggcatccgaccgcgcggctcagcgccctggagaaccggtatttcctgcaccgcgcggtccgattcatggccgggcaggggatccggcagttcctcgacatcggcaccggcattccgacctcgccgaacacgcacgagatcgcgcagggcgtcgacccgcaggcgcgggtcgtctatgtggacaacgacccgctggtgctggtgcacgcccgggccctgctgaccggcaccccgcagggccgcaccacctacatcgaggcggatctgcgggagccggcgcggatcctggccgccccggacgtgctggccaccctggacctgcgccacccggtcgggctgctgctgatcgcggtgctgcacttcatccgggacgacgacgatccgcgcgcgatcctcgacacgctgatcgacgcgttgccgcccggcagtgtcgtcgcggtctcccacgccaccccggagtacatgccggccgagcaggtggcggcactgcgcgcggtgatggagaagcagtggcaggaccggaccggcgacgagctgcgggcgctgttcgaccgcccggacctggagttcaccggtccgggcgtgcagtcggtggcggcctggtggccgcaggacgcgccgcagccgcgcccggcggtcgaggacatcgcgtccaacggcctggtggcccgcaagcgctgactcagaccttcgaaccggccgcgatcgcccagatcgtgccgacgccctgacccttcaccgagcaggcctggccgggcaggctgacgaagatcgaggtggtctcgtccggcgggtagacccggatgccgcgcacgtcgaccggcttgcacttgtccttgtcgaagaagccgacgttggtggactgcaggaccgcgttggccgcctggcccggcttgagcgtgacggtcacccgcttgcgctgctcgccgcgcttgagcgggtcgttgacctgggtgccgttctccccggtgacccacgagaccccggggtagccgtacagcgtgcaggtgcggtgcgacgcgttcgtgaagaccagcggctcgtacgcggtgcccgccgcgccctcgcccgcgccgacgctgagtttcaggtcgccggtgtggcagcgcgccgacgccggtttgctagctagctagcggcggtggtggtcgccggagcggcgccggcggtggtggtcgaactcccggtgctggagcagcccgtcgcgagcaggagcggggcggccagcagaacgatcatggtgcgcttcatgactactttgtagtcgccgggccggccggcggacctcatcaaatcgtgccagccgccagcagccgctgccggtacggccggatcgccttcggcggcatgtcgacggcgagcgcgccgaccatccggtcaccccggtggtacaccgcgacgaaccggcgttgcgccagggacccctcggtcacctcgacccggtcgtgcagccgcggatgcccgtacgcgtggatcttcaggtcgtactgctcggaccagaagtacggcaccggggcgaacggccggccggcgccgagcaggttgcgggcggcggccatggcctgctcccccgcgttggtccggtgctcgatccgcaggtccacgccgaacagcgggtgatgccagcgcgccacgtccccggcggcgtagacgcccgggccggccgcgcagaacgcgtcgcagaccacgccgtcgccgatcgtcaggccgctgccggccagccactcggtgttcggcagggagccgatcgcgaccagcacctcgtcgccttccaggtgggtgccgtcggccagcagcacgccgcgcccggtcaccgcgctgaccgcgacgccggtgcgcagatcgacaccccggtcggtgtgcaccgcggcgagcacccggccgatctcggtgccgacggcgtgcgcgagcggcaccggcgccggttccagcagggtcaccgcacaccccaggccgcgggccacggcggcgcattcggcgccgaggaagccggctccgacgacgatcaggtgtacgccgtgatgcagtctcccgcgcagcgccagagcatcgtcgagggtgcggatcgcatgggccccggcgcccgggagggtgcgcggccggaccccggtggcgatgatcagagcgtcgaagccggccgtgtccccgtcgtcgagcagcaccgtgcgatcggccagcccgaccgcacgcacaccccgacgcagatccagatcgagagccgccagctgctcggccgtccgtagaaggatccgggacggttcccactcggcggccaggatctgtttggacagcggcggacgatcgtacggcagatggttctcctcgccgatgaccgtgaccgtgccggtgaacccggagcggcgcagggtttcggcggccgtgatcccggccgccgaagcccccacgatgacgacgcgcctcacgtgtcgatcaggtggagggcggccgccgggcagatcgcgaccgcgtcccgcaccgcgtcgaggtgttccggggcgggcgtctcctccaggatgatcgccacgccgtcctcgtcgcgctggtcgaagacgtccggggcggtcatcacgcactgaccggcggcaatgcaccggggctcgtcgagctggaccctcgtcaccaccggaccggaacctcctcgaggccgccgacgatcaggccggtgcggcgccgcagctcctccggcgggaccgccagctccagggtgggcagccggtccagcagcaccgcaagggtgacctgcagctcggtgcgggccagcgcctggccgaggcaggagtgcgggccggcgccgaagctcaggtgcgggttgggcgagcggtccagacgcatctcgccggcctgctcgtaggcggtctcgtcgcggttgccggcggccatgctggccatcaccacggtgccggccttgaccgggcaaccggcgatctcgatgtcctcggagatgtagcggggcaggccgatccccgggttcgcgtcgaaccgcagcgactcctcgaccgccgagttgatcaggccgcggtcggcgaccagccgctcccaacgggccggccggtcggcgagcagcatcgcgaccatcttgccgatcatgttggcggtggtctcgtgcccggccaccagcaggccctgggcggtgaggaccagctcggtctcggtcatccggccgtcctggctgtcgacgatcgcggccagctcgctgagcaggtcgtcacccggctcagcccgcttgtcccgcacgtgctgggccatgaactcctggaattccaccgcggccttggtcagctcggcctggtcgaacctggtcaggttcagcatggcgtcggaccagtgcgagaaggtgtcgcggtagcccgggtcgacgccgagcagctcgcagatcacgaacacgggcaacgggaaaccgagcgccgactgcaggtcgccgggctgcccggcggccaccatctcgtcgatcagccggtgggcgatctgctcgatccgcgggcgcatcgcggtcacccgcttgaccgtgaatgacctgttcatcatccggcgccagcgcgggtggtccgggctggcgatcatcgcggactcctcccggttgaacacgccgccgtcgtccgaggcggagatcttcgcggcgtccggccgggcgaggctgtgcgtgaaccgcgggtcggcgagcagccccttgacgtcgtcgtaccgcgtgaccagcagcgcctcgtcgccactgacgaggcggatccgggcgacgggacactcgttgcgcagctgctcccattcgggagacgggtcgagggcggcggggtgagcgaacgggtaggcgggaaccgtatcggtcatcagtcctccagacggtccgaacaggaaggaccgtaggacagcccgcgccccggaacaagggcgcgaaaaccgatcaaggaattgacctgcgacaattgattctgccatttttcgatatacggcaccggccgccgccgggatctttcagcgtttctccgccgtcgcggaccccggcgtgcggccatccccggaccccgcggccggcggtcggcggtcggcggtcggcggtcggcggtcgaccctcccgcctcagccccggcagtggtaggcgacccgggtgccggcctgcaccggggtcggctcgacgatgttgacggtggcggtctcggcggcggtgcccaccccgctgaacgcccacttgagggtcagcgtgacggtgcgctgcccgcgaccgacccgctcggtcagcatcgcgccggatgccgcgtcggagcggaaccactggtaacggatggttccgccacggccgttggtgcgcacggtggcgaccaccggcacggtgacgtcgcagcggtccccggccggctggggcaccgccacggtgaccccctcgaccaccagcgggctgagccgctgccacaggtagagcccgaccacgccgagcagcaccagggtcagcaggctagctagctagcgaccgcgaagtggtagcccgccccgccgagcagcacggccgcgacgagcgctccggcggccagcgcggtggtccgccggccccggcgcagccgacgtgccgggctcaccgcgctgctgccgaacgtggtggtggccacgctggtcgcgccggaggagccgtccgggaacggccacagcgcggcgagcagtgccgcgcgacgggccaggtcgcgcagcccgtggtcctcccagtccgggccgtaggcggcgccggccacccgctccagcaggtcgaggaaggccaacgcgtgcggcggccggtcggcgggctgcttggccatcccgcggcgcagcaaatcgtgcaccggctccggggtcgccccggtcgggatcggggcgtgcgcgtgctggtcgtgcagggcgaacaggttggccccgtcgtacggcgggtggccggtcaggcactcgaagaaggtggcggtggcggcgtagatgtcgcaggccggggtgaccgcgccgccggtccactgctcgggggccatgtagcggggcgtgccggagacgacggtggcggcgccctggccgaccggcacggcgatgccgaagtcggcgagtttgctccgcccgtcgccggtgaccagcacgttctccggcttgtagtcgcggtgcacgacgccgtgcgcgtgggccgcggccagcccggacagcgagcccttcagcacgcacagcgccgcctccggggtgcccgggccgtgctcgcgcagcatctgacgcagcgacaccccgttgaccagctccatcacgatcgccgcgccgtcggcggactccacgtactcgtagaggcggcagacgtgcgggtcgtcgatctcgccgagcagccgcgcctcctgccggaaggcggcccggaacgcggcgtcgtcgctgatctggccggtcaggtgtttgatcgccaccggggtgccggtcgcgtcgtgggtggccagcacgacactgccggaggcgccggcgccgagcgcacgaacaggtgtgtagccggtcggctgccagccgctcatgcgggatgctccacagtctcgtcgaagggcggggatcggtccccgccgcgccgcccattgtgaccacccccggtcaaccgggcatcgacgcaacggctgctctctcgcgtcggatggccgacaccatccgcgggacatcgaccacaatcgacggtatggtgcagcaggaaagcgcattcctgcagaggaggctccatgaaagcggtgctgctcatgctggccggcctgctcgccgcgccgggcaccccggcccggccggtgctgtccgccgccgaggccgccccctacaccgcggcgaactacctcggtttctccgggacgtacgcgcatccggtcgccgacccgtggcgtcccacgccgatccgcaccccgcgccggccggacctggtggtcggcgggcgggccgggctgcccgacgtgcagcaggcggtcaacgcggcctaccgggccggcggcacgcggcggctggcgatcgcggtccggcccggcacgtaccccggcaccgtcttcatcccggccggcacgccaccgctcaccctctacggcgacggccccgccgaccgggtgagactacagttcacggtggacgccaccagcaccccggcgcagtgggcggcccaggtcaacgccaccggacggtacgccgagggcgacccggcctggccgatgttccagtcctgcgccaccaggaccaccgccaccgtcgggctgtgcgccaccgtcgtctgggcgcagagcaccgacctgcagctgcgcggcctgaccatcaccaacaccctgctggacaccgtggaccgcggcacccaccaggccctggccctgcgcaccgacgcggaccgcacccagctgcaggacatgcggctgatcggccggcaggacaccttcctggccaacgcgaacgacgtcacgtcgatcgcccgggtatcggtccgccgcagctacgtcgagggtgacaccgacttcgtcttcggccgcgccgccgcggtcttcgaccactgcacgttccgcctggtctcgacccgcaagccggccggcggggtgatcttcgccccgaacaccgacccgcatttccggtacgggttcctggtgacccgctcgcgcctgctcaccgacgccgcctaccgggccgcgccgaccgggcacctgggccgggcctgggaccagggggccggcgccaccggctacctgcccggtgtcaccccgaacggccagctggtgatccgcgacagccatctgggcgcaggcttcgacaccgccgccccgtgggcgccggccgccaccacgtcccgcccgttccaggcccgggtcgacgtgggccgcgacctcgacgacgtcgccgccaaccggctgtgggagtaccgcaatcacgggcccggcgctcagtaggagcggggcagccccagcgagaactgggcgacgaagttgagcgccatctcccggctgaccggggccagccgggtcagccgggacgtggccagggcctggaccaggccgtactcggtggccaggccgttgccgccgtgcgtctggatggcctggtcgacggcggcgcagacggcttcgccggccgcgtacttggccatgttggcggcctcgccggcggccttgagctcaccggcgacgtgcagcgcggcggccttctgggtgagcagccgggccgcctcgatctcgatgtgcagcttggccagggggtggctgatcgcctggtgggtgccgatcggtacgccccagacggcacggtcgccggcgtagccgacggctttgcgcagcgcccagcgggccatcccggtggccgaggaggcggccatgatccgttccgggttgaggccggcgaagagctgatcgaacccggcctcctcgctgccgatcagcgcgtcggcgggcagccgcacctcgtccaggaagagggtgaactggtcctccggcgcgaccaggcccatgtcgatccggcgatacgtgaagccgggcgcgccgaccggcaccatgaacagcgaggggcgcttgccgacccgggcgacgatcagcacgtacgaggcttcgtcgaccccgctgatgtacgtcttggtcccgctcaggatccagtcgtcgccgtcgcggcgggcccgggtggcgatctggtgggtgttcgagccggcgtccggctcggtgatgccgaagacgtaggtggccgcgccggtcgccaggccgggcagccagcgccgctgctgctcggccgtgccgaactgggcgatgaccgtgccgacgatcgccggggagaccaccatcagcagcagcgggcagcccgcggtggccagctcctccaggaccgcggccaggtcgccgatgtcgccgccgccaccgccgtactgctcgggaatggacaccccgaggtagcccagcgccgcggcctcctgccacagttcggtggtcttgcggccctcgcgggcggcggcgtagaagtactcctcgccgtacttgcggccgagccgggcgaccgccccacgcagctcccggcgttcctcggactccacaaaagcggtcacgtcagctcccgtcgatcactgctagcacgtcgccggcggcgacctggcggccgaccgccgcggacagggcggtgaccaccccgtcggcgggcgcggtcagggtctgctgcatcttcatggcctccaggacgaccaccggggcaccggccgcgacccggtcgccctcgcccacgtggaccgcgacgaccaggcccggcatggacgccagcagggagccggcggccagggtcgcggccgggtccccgaacaccggcacggtgagcaggtcgtacgggccggccgggccgtgcacgtcggcgccgccggcgtgcggcgtcacccggtacgtctcgcggaccccgtggtcgtcgaggaccacccggtcgccgtcgaccgacacgacgccgacgccgggcagccacgaggactcgatccggccgcagcgggcggtgtaggtgaccgcgtactcccgatcgaggcagcggtaggtccggacgcgggcggcgctgggcacgttgcgccaggcggccgggatgcgtgcctgaacattcgcggacccggcggtccggaccgccgatcccacggcggccgccagcgccgctttgcggaccgcgtggtcctgcccgacgccggtccacgcggcgagcttgcggtcgagcagggcggtgtcgaggcggccggcggcgaagtcgtcgtcggccaggatcgcgcgcagcaggggcaggttcgtggtgagaccgtgcaggcgcccgcggcgcaacgcgtcggcgagcaggcgaagcgcggcggggcggtccggtccgtacgcaatgatcttggcgagcatcgcgtcgtagcggaccccgacccgactgcccgcctcgaccccggaatcgacccggacgccggcggcggcgaagtcgaaagcgcgcagctcaccggtctgcggggcgaagcccgcggccgggtcctcggcatacaggcggacctcgacggcgtggccggtgatcggcggcggcgccggcggcagggcgtgaccctcggcgatcgcgatctgctgggcgaccagatcgagaccggtcaccgcctcggtgaccgggtgctcgacctgcagccgggtgttcatctccaggaagaagatccggtcgccgtcgacgaggaactcgacggtgccggcgctgcggtagccgaccgcctcggccgcggcccgtgcgtgccggtgcaacgcggcccgcacgtcgtcgggcagcagcggcgcgggcgcctcctcgatgatcttctggtgccggcgctggactgaacagtcccggtcaccgacgatccagatccggccgtgccggtcgccgaggacctggacctcgacgtgtcgggcgcggggcaggtacggctcggtgaagaccgtgccgtcgccgaacgcggactgcgcctcggcggccgcggcggccagttcggaccgcagggtccccgggtcggtgacgatccgcatgccccggccgccaccgccggcggcggccttgatcagcagcgggtacgtgtcggcgtcgccgccgaggatcggcacgccggccgcggcgaccagcttcttggcgcggatcttgtcgcccatcgccgcgatggcgtccgggtcggggccgatccagatcaggccggcggcctcggttctgcgggcgaagtcggcgttctccgacaggaagccgtagccggggtggatggcgtcggccccggccctgcgggcggcgtcgatgatctgttcggcgtcgaggaagtcggcggccacggcgatgtccgcctcccggacatgcaggtccggctcctcccgatgaacagcgacagtctcgatgccgagattccgacacgtccggaatatccggcgggcgatctcgccccggttcgcgaccagcagcctgcggatcatcacagccggaacactccgtagccacgagcgccctgcacgggcgcgttatgaatgacggacaggcagatcccgagcacggtacgggtgtcccgcggatcgatcaccccgtcgtcgtagagcatgcccgacgtgaagtacgccagggactcccgctcgatctgcgcctcgatcgccgcccgggtccgcgcgtccgcctcctcgtcgaacggccgaccggccgccgcggcagcctgccgggacacgatggacaccacgccggccagctgcgccgggcccatcaccgccgacttggcccccacccagctgaacatgaaccgcgggtcgtaggcgcgcccgctcatcccgtagttgccggccccgtacgacgcgcccatcaccaccgacaggtgcggcacccgtgaattcgacaccgcattgatcatctgagcgccgtgcttgatgatgccaccctgctcgtactccttaccgaccatgtaaccggtcgtgttgtgcaggaacagcagaggcgtgtccgcctgattcgccaactggatgaactgggcggccttctgcgcctccgcactgaacagcacaccctgcgcgttcgcgaggatcccgatcggatggccgtgcaaccgggcccagccggtcaccaggctcgtcccgtacaacggcttgaattcgtcgaactcgctgccgtcgacgatccgccacaccacctcgcgcggatcgaacggcaccttcaaatccgacggaatcagaccgagcagttcctcggcgtccagcaccggctcggcatacccggcccgcggcggcgggcccagcttgcgccaattcagccgtcgcacgatctgccggccgatcctgatcgcgtcggtctcgtccaccgccaggaaatcggccagccccgacgtgcgggcgtgcatctgcgcgccacccaacgactcgtcgtccgactcctcccccgtggccatcttcaccagcggcgggccacccagaaacaccttcgcgccgccggcgaccatcaccacgtagtcgctcatgcccggcacgtacgcgccgcccgccgtcgcattcccgaacaccagcgcgatcgtcggccgccgatccgcgctcgcctcggtcaacccgcggaaatgccgcccacccggaatgaagatgtccttctgcgtcggcagatccgcgccacccgactccaccagattgatcgtcggcagccggttctcggcggcgatctgcgcggcccggaaactcttcttcaccgtgaccggattgctcgacccgccgcgcaccgtcggatcattggcgacgatcatgcactcgacgccctcgacgacgccgatcccggtcaccaccgaaccgccgacggtgacatcggtgccccagccggccagggtgctcagctccaggaacgccgaatcctcgtcgagcagcagctcgatccgctcccgggcggtcagcttgccgcggcggtggtgccgctcgaccgccttcgggccgccgccggccacggcgacggcgtgctgccgctccagatccgcgacacgctccagcatcgcggtccgattgaggtcgtacgagggtggcagggtcacagaagctccgtagggatgtcggcgagacgggaacgaagccactcgccgagggccttcgcctgcgggtcggggcgggtggaggcggccacgccgtcgccgagcaggccggcgatgacgatgttgagggcgcagagattcgggagggggtgcagggagatcgggaacggggtggattcggggaggagggtgcggaggcggtcggcggtcagccaacgggtcagccagcggaaggcggccaggcggtgggggtgggcggcggggatccagatgcccaggttggcggtgccggctttgtcgccggagcgggcgtgcaggaggtggccgaggggggctctggtgtggtggcggtagccgtcgggtgccgggtggttcgggggttcggtggtcgtcgggtggctgcgctgccccccgtccaccacggcccgccctcccagggggaccatccctgagccagtatcgtcgccaacgccacgatcatgcggatcccctgtggacaagccgccagtgtggacaacgtccccgcgctccgaggcgggcggaccagcgtgaaccccgtcagcggacaccacgcgacccggccgccccgacccggcggaaaccccggcacgctcccaccccggcgccgccacctcgacgcgcacgccgtccggcagcaccaccacgtgcggcacctcaccctgaggcagataggccgcttcgaaaaccccgtagggagtcgcgcccgacggtggccccgtcacgtggaatcccgggtacgacgccagcgccagctcgatggccgcaccgctgaagggccgccccacgacatccgggtcggcatccttgccgtggcagtgcagaaccgccgcgccctcggcctgagtgcccgggtccggacggtcggtgcggatcaggtcccagacgagagtctccggcctcctgccgagaccggattcgaactgctcccggacccacgccgctttggcttcgatgtcgagcccggtgaggacgaacgaaaccgtgttccgatatccacccaggcgggtgatcccgattttggtcgtggcgggtggagcttcaccccgtaccccgcaaatcgctacccggtccttttccggcgcggcgagccggatggtgtcgaggcgcgcggtgacgtccgggttgagatatctcgggctgtcgatctcgtagacgagctgggcggtgaccgtgtcctcggtgacggccccgccggtgcccggatgtttggtgatgaccacggcaccgtcgtcgtcgatttcggcgatcgggaagccgagcggccggctggtgtcgatggtggcgaatccgctgaagttgccgccggtggcctgggtgccgcattccaggatgtgaccggcgacgattccggcggccagtttgtcgtattcgtcgcgccgccagccgaatgcggcgatcgcggggccgagggtcagtgacgcgtcggtgacccggccggtgaccacgatgtcggcgccggatcgcagggcttccgcgatgccgaaggcacccagataggcattcgcggtcagcgcgcccggaaaggccccggtcagcaggtcgtcgccggccacgtgggcgacccggaccgtcggatcgagtgcccggatcgccccggcaagggcgcccgggttgacgcccccggcgttggccacgatgcggacgtggcgggcccgggccagcgacaggcagtcggcgacctgccggaggaacgtcttggcgtacccggtgtccgggttcttctggcggtcgcggccgaggatgagcatggtcagctcggccaggtagtcgccggtgaggtagtcgagcggcccgccctcgagcatctcgcgcatcgcggtcaggcggtcgccgtagaagccggagcagttgccgacgcggatggtgcgcatctgtgccaccccttagaaccgctcgaagccgccgctggtgtggatgccacgttaggcaatctgacaaaattgtcaaggatgcccgcggagcccgatcgccgcggcccacagcttcgacatgtggctgaccacgacctcctcgtcgagcggctcgcgcagcgagtagatgacgtgcgccatctgctcgaccatggcgcccagcacgatcgcggtcagccgcggatccagatcggtgcgggccagcccggcctcctgcaggcggcgcaagccctcggcaccgcgatgcacataccgctcgcgcacctccagcagcagctgccgcagcgtgtcgtcggccgccgcaccctgctccaccaggcgcaacacccgcgaggcgttccgccacgcgcgcagataaccacggttcgaggcgacgatgcggacgtacgggtcgtcggcggtgtccggcgcgaccagactgtcggtgaacatctcctcggcgaccgcccgcacgatcgcgcccagcaggtcgtccttcgactcgaagtacgtgtagaaggtcccgtacgagaccccggcggccgccgcgacctgctccggcgtgaaagccggccagccccgggtctccagcagctcacgcccggcggccagcagcgcatcgcgggtacgccggccgcgcgcggtgaccggggcggtgggggcggggttggttctcgatcggcccatgcgttcatcatggccgccccgtccggctacgaccgaacggacatcgacatatcaggcgccgccggtccaggatcaccgtggacgcgctccccgatgaacaccgccggaccaacgaccgtgcacccgctgaacggatggctcagcgggacacgcggccggtcggcccgaagacgaccgggacaccgggcgagtagaggacactgaccggcggggtgtcgatgccgggcagcccggccgccgccagcaggctgtcgtccaggtccagcagctcggcacggtgcagcggccaccggggatgatcgttggccaggtgccgggtccgtccccacgcccgggtgtgcagtccccaccgggcggtcaggaagtcctccaggggcgacggttcggcgatcggtgcgccgacccggatccgcatccggttggtcgcgggccgcgggccgggccagcgacgccgggagacgtaggcgagctcgtcgccgtcgcggacgatgcgcatccgcgcccacatgtacggcagctgcaggctggcccgggcgaccagcaccggaatcagccgttcggcctccagcgagcggaacaccacggcccgccggccctgcgcgtcgacgctgtagagccgcacgttcgtctcgcagaacgtgcccaggtacggcacgccggggctgcccaggaaaccgatccgttccatccggaaaccgatcacgccggcgtacgtgacgccaccgatgacatccggcacggtgccggccggcagcagcggcgccacccggtccgggtcgaccgcccagtgcaggaaggccaggtcggtccagcgctgcccgagcacggcgcgggccaccggccgcaccgtctcgctcgtgatctcctcgacgtccacccgctaaggatgacccagccggtccagcccggcggggtctacccgcacctgcgcggccaccttcgtcagctcgtcgaggctgagcccgtcgccccggctgctcagcgtcatcaggtgggccggttcttgccgggtgcgtcggtgcgctgcgggtgccgggccgggtggccggcgacggtcagggtcgcaccgccgggacaggaactcggtgacggcaggaaaacgctcccacgcccgtcgaatggtgacacggcggcggcgaaggtcagaacagcgccatcgtctccttgagccgctcactggcccagtcgtagttgccggtgccgggaaaattccggtaagcggtctcgatcgtcatgatcaacgccaggtacaggcagtagaggcgccggcggatccgctcggcctcggtggccgggccccgcccgtacccctggatgaacgccgacgagtcgccgtaggcgggcacctcgctgccggtgaacccggcctcgatcagcggatcgccgaagaacgcccgctcgtggtcgatgatcgcgacgacccggccgtcgcggaccatcacgttgttgtcccacatgtcccactcgacgaaccgcggctcggtcacctcgtcgaggctgccggcatgcgcggcgatcaccgcgcggacctcgtcgtagccgaagccgagcggcacgtcgcggcgttccccgtcgcgcagcaccccctcgatcatcgcggtgaacacgacccgccaactcgggtcgccggagccgtcgagcggcccgaaccgctcgccgcggatggcgttgagccggcgattgatctcgcccagcgataggttgtacgcggcacgctcccgcggcgattgctgcccgcgcagcatgccgaggttgtcgccgtcgatgaacgccatgaagaagtagtcggcgtcgcacagctcgtggctgcggtcgacgaactccacctccggcaccggcacgtcggtgtgctcgcggatcaggcgcagcgcggccagctcggtcgccatcgcaccccgctcgtacgtcatcacctcgacaccgggcggcggcgcgatcttcaggaccgtccggtgtccggaccgcaggcggatccggtacgccacgttgaaccagccgtggctcagctccacgtaccagtcgtcaccggcgggcacctccgcccggccgtaggcgcgctcgaccatcgcgcgcagcacatccgggctctggcggttcttggtgatgctctccacgaccaaccaggatgccgaaacctccgggcgggcgcagcccccgctacggcgacccgacggatgatcgccggtgggtggaggacgtcatccggggcagcatccgggctgcggccgcgtgacctcggcgaggaggtttctgcgctacggcccggcgtcctgccggccttcgtccgccgacccgacggctggcaagccgttcatgatctccacgagggctaagggcaggtgggctcgtaggcgagttcgggaacatagagggcccagtcttcgtggctgagtccgccggtgatcgcgcaggcccgttcgctcgcccgatcgcggagatcgttgaaatcggtcaggtcccacagcatcgcggtgtggtcgtggctgccggtggcgagggtgcgtccgtccccgctgagcgccaccgcgtccaccgcatctagctagctagtgtacaccggagcggtgctgctggtgagctgggccagccgccgtggggcggcgcggtcggtcggatcccacaccatcacggtgccgtcaaggccgtcagtgacgagggtgcgtccgtccccgctgagcgccaccgcgctgaccacggcggtgtgaccggtaacggtgcccgcatagtgagtccttacgagggtttcgaccagtccggcctgcgactgcggccccgggtagatgtgccgggccgcgatccccagctgaatcgcggttctcggatcccggtcgcgggcttcgccggcctgccccaagagtcgccggccgatggcgatgcgctgctgcttgacggcttcctcccgctgccgctcggcctccgcagcagcctcgtgcgccttgcgctgctcgtcggcagcgatcttccgctgccgctcggcctccgcggcagcgcggttcgccttcgccttctccgcatcagcgacaccccgctggcgccgcgcctccgcggcggccttctgcgcccgccgctgttcagccgccgcgatgccctcctggcgccgggcctcccccgccgcccgcagagcccgttgctgctcagcctccgcgacagcctgttggccccgcgcctcctcggcggccttctgcgcccgctgctgctcagcctcgacaatctgctgctgactacgagcctggtcggcagcctcctcagttcggtgttgctcggccgccgtggcagcacgctgccgctgcaacgcgacattcgtcgcggtcacctcaccccgggcgttgcgccacgccacggccgtaccggccaccaacagcagcagcgcacacaccacagcaagcgcgcctcgacgcatccgcagcatctgccggtgacggatgacgtcctcaccgtcgaggtcctccttgctcatcccgtgcataccggccgccaactcggcgatcgcgtcccggaaccggccgtgccgcaagtcgagttcgtgttccgcccgggcccaccgtaggtccaggtgccgcggctcctcaccgaacacgccccgcaacgccggcggtaccgcagtcgaacgctccaagtccacgtcgccggcgtcggcgtcccacacccactcgccggacgtcaccaccggcagcaaccggtcaaccgaatgccgcgacagccaatgctcgatctcctggttcacccatggtgacgcggccgcctccggggaggcgagcagcacgaagaactccgactgatccagtgcgactttgatcgacgaccacagggcgtgactcaccgccaggccggtctgatcccggaacacctccaatgcccgcggccggtgccaccgccgcgcgagccgctgcaggccacgctgaaccgccggcgccaacgccccatcagcggcatggctgtacgagatgaacgcgtcgtagcgcatcggagcccccgatccccaggaattcagcgaccacgatatacggcggccacccggagtcaggaaagcccgcggcttcgccggtagccgcgatgccgggggtctcgctggcgcggagatgaaccggtcggccgggaacgccatgttcagcgactgatgcggccggttggtgtcgtcctcattccggaacgcgcgcctcacgccttcggcgacgtcgcgcgccggccccggccgcgcatactcgggttccacccagacacgacgaagcccgaccggattccgcgcgggaaccgatcgggcctttcgttcggggatccggacggtgatacctccggcggccaggatctccgaccctgccccggatgatgcctccgggtccagggcgctgccctggacccggcgctccggcgggctggggtggtcgaggtaatgcgggcgctcagaacaggtcgttctccatcaccttggtccacgcggcgacgaagtcccgcacgagccggtcccgcgcgtcggcgctcgcgtacacctcggcgagagcccgcagctgcgagttcgacccgaagaccaggtcgacggcggtggccgtccgcagcagatccccggtgctcgcgtcgcgaacctcgtagacgtgctcctcggactccgacgccgtccaccgggtgcccggcgccagcaggtcgacgaagaagtcgttggtgagccgccccgacccggtggccccgaccccgatcccgcgcaggccgcccagcaggacggtcatctccggcgcggtcaggttcaacatgtaggcccgctcgaccagcagcacctcgggctggagcttctcccccgggcgcaggtagttgcggaatccgtcggcgcgcggctccagcacggcgaacgactcgacgtcggtctgctcctgcgtcgcgtcggtgcggcccggcttgaacggaacgctgacctcgacgccggcgtcacgggccgccttctccaccccggccacaccggccagcacgatcaggtcggccagcgagatcttcacggtcgacgaccgctggatctcctccagcctggccagcaccggcagcaccggctggttgaccgcccaggaacgctgcggctccaggcgcagccgggcaccgttggccccgccacgcttgtcggtcgaccggaacgtcgcggccgacgcccacgcgacaccgaccaggtcggccgtgctcagcccggactccagaatcgtcgccttcagctgggcgatctcggcgtcaccgggcagcgggtgctcgacggccggcaccgggtcctgccacagctgcgcctccggcacccacgggccgaggaaccgggacaccggccccatgtcccggtgcagcagtttgtaccaggccttcgcgaacgccagcgcgaactcgtcggggtgctccaggaaacggcgggagatcttctcgtacgccggatcgacgcgcagcgacaggtcggtggtcagcatcgtcggcttgtgcttcttcgccgggtcgtgcgcgtccgggatgatcgcctcggcgtccttggcgacccactgcttggccccgcccgggctggtggtcagctcccactcgtagccgaacaggatctcgaagaaccggttgctccactgtgtcggcttgtcggtccaggtcacctcgagaccgctggtgatcgtgtccccggcccggccgctgccgtgcgtgctcagccagcccaggccctgcgcctccagcggcgcaccctccggctccggaccgacgtggtcggcggcgaccgcggcgccgtgcgtcttgccgaacgtgtgaccaccggcgatcagcgcgacggtctcctcgtcgttcatcgccatccgggcgaacgtctcccggatgaagtgcgccgcctgcgccgggtcggcgttgccgcgcggcccctccgggttgacgtagatcaggcccatctcggtggcgccgacaccctcggacatcgtcttgtcggagacataccgctcgtcaccgagccaggcgtcctccggaccccagaagatctcctccggctcccaggtgtcgacccggccgaagccgaaaccgaacgtctggaaccccatcgactccaacgccacgttgcccgccagcaccagcaggtcggcccaggagatctgctgaccgtacttctgcttcaccggccacagcagacggcgcgccttgtccaggttcgcgttgtccggccagctgttcagcggcgcgaaccgctgcccgccgtcgcccgcgccaccccggccgtcctggatccggtaggtgccggcggcgtgccagctgagccggatcatcaggccgccgtagtgcccgaagtcggccggccaccagtcctgcgaggtggtcagcacctcggtgatgtcccgcttgagcgcctccacgtccagcttggcgaactcggcggcgtagctgaacgcctcgccgagcgggttgctcttcgatgagtgggcatgcagcacggacaggtcgagttggttgggccaccagtcccggttgccccgcgggcggccgccggtgcgcgcctgcggcgagggaatccccgggttctcactctcgctgccgccgtgcccggtggccgagtcgtgggcgaccgggcagcccgacgccttctgatcctggatgtcgctcatcacaatccttccgaaggggccgccgttggcccgacgccgcccgaccaggctaggcaattcttctggaacacttcaagttctgccccgatgacgcggcccaatctaccccccggcggtccgccgaaactgggaaccgcactccggccggcgtccaccgggccggccgggtcctccccgtcctcggccatccaccggccgatctcgacggcgccgcgcagcaatccggcgaacggcggcatcgaccgacccgcgtccgcgtgcagcaacgcgaccagggccgcccgtcacagcgctgaaaagcatcggtatatcgcgttgccagatcggtctccgcatcgctcagcccgcgcggcgccggctccgcggcccgcagccacgctcatgcccccgatcgtagaacagccccctgacgatttccgccctcgcacacacggtctacagcatcctaggaggctgggttgcggggtgaggatcgaaggctccatcgccgttcgaaccgctcgtggatgccgccgcgagcgctgatcgatcaggaatcaggattggacacggccgtcggcgcggagccatgctgagctgcatgacaccggcagcaattcctactggaacagatccgcggtacgtcgtgatcggggccggcgcggtgggcgcctcgatcgccgctgagctccaccgggccggggcggacaccctgctggtggcccgcggcgcccagctggcggcgctgcgcgcggacgggctccgctacgttcgaccggacggtgtccaccaggtgcggatcccggtcgtcgccggaccggaggaggtcgagctgggcgagcacgacgtgctcgtgctggcgaccaaatcgcaggacaccgcgaccgcggtacgggactgggcgtggcgtccggtgaaacgcgccgacggcgccaccggcctgtccgccaccgacctccccctggtcaccctgcagaacgggctggacaacgagcgggccgcactgcgctcgttcgcccgggtggtcggcggcgtgatcggcatcccggccaccttcgtggtccccggcgaggtggtcaaccacgccgccgacgcgcccgccgtcctgttcctcggcagctacccggcccccgcgagcgacccgctggccgagcggatcggggccgggctgcggcggggcggtttccgtgtgcacgtggtggcggacatcgtggcgtacaaggccgggaagctcctcggcaacatggccaacacgctggacgcgctctatccggagagtcccctgcgggacgccgcgctcaggacgctgcaggccgaggccaccgccgtcctcgccgccgccgggatcaccccggccgccctggatctccacgagttccggctcggcgagatcccctcccacccgcgggtcggcgcctccacccggcagagcctggcccgcgccaccccgccggagaccgactacctggacggcgagatcgtcctgcgcggccggctgcacggcatccccaccccggccgccgcggcgatccaggcccggctgcaccgcgccctcgccgacgggaccccgcccggctcactgaccgacgacgatctggcccgcaccctgccctgaccggatcagccgccggtgggccgggccagcgcggccaggctcagcagcaggtggatcgagtgggcgtgccagtagtcggagtgggcgccggtcacgctcagccgcggccgggtgaagaccggcgaggcgtccacgttgacgatcggggtggcgaagtccgcccggtggtacgggtcgccgggacggtgcagcggaatcgtcgagaccagaccggccggggcggtcgcgccgaccgccccgatgcccggcctgcgctccatcgcccggtgccagatcgcgttggcgtgatcgagccggctgtaggtcagcacgatccggccgtgcaccacgccgtcggtcaggatcccggccagccggccgtcgaagatgtccggcggcgccgccatctggaacgccagatacgtgtccaccccgaacggatgccggctgcgatggtcccagcccagcgtgccggcgggacggtcggcggcccggcggatcgcctcacccaggaaccgaccgccgaacgagtgcccgacgcagtgcacgtactgcccggccgcgttggtcagccggtccgcgccgcgccgcggccggtcccgctgctcatcgaggtagccgagcagctggccgagcacgaaggcggcgtgcccgccggtgctgaccgcgtgcgcccgctcccggatccgctgatagccgcccggggtcggcgcactgctcgacggccactgcaccccgatgaaccacggcacgaacggtccggccgcgccgggcagcgacgcccatcgctcccggccgttccacaccgcaccgaagaaccgggcaaaagacgattgcgcggtacggtgcggcgtccgccagccgtgcacgaacacgaagatgtcggtcaccgaccggggcagccgcagccgggacgccaggtgctcgcggacccgggcggccggcaccggctcggcggcgtcatcaagcaggcgtccggcggcgttcaaccggatcgtccgataccaggagaatccgctgcgtcgcgggagccgggtcggcactgttcgagacgtcaaaataggtgtccatccctcggtacgacgagatcgccagacccagcgggttggcgtgccgctcggcgaaaccccgggccagcccgcgcaccacggcaccgaccgacaccccgcgcagcagctcccggaagaactccacggcgtaccgcgcggcgaacgacgccggaatctcgatctgcgggccgatcaggcagttcgcctcggcggccagcagcgccaggccgaacgagtcgagaaacatcgaggacagctgggcgccctcgcacgcgttgatcagcaccaccgggctgtgcaccagcggccggccggtcagccactcccggaaatgcgtcttgtagatcgggcggccgtcggtcagcgcgatgtacgcctcctccggcccggccgcggtcacccacccgtgacagttgaagtacatgatctggtcgttgtagtcgtcggcgcgcaacgcccggtccagcgccgggaacgtctcccgccagcgccgctcgatccgctcggccggcagcgactccagcatctcgcgcagcggccgcagcaccggcggcgtcatccggtccagggccgcgtcgtagttcagcccggcccggatcccgccggtggcgtccagccggtgccggaacgagtccggccggtccgagaagacgtgctcgacgtggtgccggaagccgaggaaaccatcgaactcccaggcgcagtcgtcgtccagcagatcctgcccgtccggcgggacgtagagcatctgccagggcaggaagatgacgtcactgtggaacgagatgacctgcggaccggcgcgcagcatgtcccgcagccgctcgccggcccggcgcagcccggcgtcgccggtcaggaagaccgcgcggaacacgtcgtagccggtccgggccagccggcgcagcgcggcgtcccactccggagtgtcccggtgcgcggacagatcgaagtcggcggcgaaccggcaccggtcgtcggccacgtcgtcgtcggccaggaacagcacgaagccgtcggtccacaccttgcgcagccggtcggccatggccagcaggtccttctcggtactggccaggcggccaccgagcgggccgccgccgtcgtcacccagcccgtcacccatcagggtcatccggcagcttccgtccgggtccgcgtccagccggaggtagatggtgcggtgcagcggcagccgggccggttccggggtccgctggcccgggaacgggtcggacccgcccagccggttctgcacggagcgccgcatgccgaggtcgtcagcggtcaagccgcctcccgctcggcccgcgccaccggtgccagaccggcctcgaactcctgcaggagcacgccgtcgcccggcgcgtacaactgcaccttgacgctgaacggcccggcgatccgcgggcgcagctcgtgcaccagccgcacgtcgtcgcgcaggtcgcgcaggtccaccgccgcgcccatcgggaccacgtcggcgccgtcggcgcagaccaggacggtcagcgaggtgccgctcacgacatcccggtagcggcgcaggtgggccgccgagatctcgacccgcagggtgaccgcctgccccacggtgatcggcggcccgtggtccaggtaggcgcgcaccgcaccggccgacccggcctccgcctccgcgtcgcgccacagcaccgccggatcgtcgccgatcagcccggcgatctcggcgaccgcccgccgatcgccgttggcggccagcaccagcgccgcccggcgcaactcgtgcaccgcctcctcgtcccggccggcgtgccgggcggcctcggcccgggcccggcgcagcagcgcgtccagcggattcccgggccgggtgagccacgggtcgaccccggcccgggcccgccgggcctcctgcagctgccgatcggccagatccgtccggccggccgcgagatacgcgctgaccagcacacaccgggtccggacctgaccggccgggtcaccgagcagcaggtggtcgtgcaggctgcggtgcgccgcgcgcagggccggccgcaggtggccggatcccggggcacggtggtggcgggccaggtgcagccgcgcctgccagtacgcgatggtcgccgcccggcgcaggtcgtcgtggtagtcggcggccgccgccgccaggatccgctcggcggtgtcccagccgtcgccggccaccgcccggtcacacccggccagcgccgaccagtacgccagctcgtcatcgggctgccccggtccggccggatcgaccggctccaccggctccggcgggcccgcatccggatcggccagccggcgcaacgtccgcagcagcggcagcatggccgccccggccggcagccgcgccgccagctcctgcgcccgggcgaaccggccggccgccgcggtgaactcgccggcccgcagatgcgcctccccgcagcggcgctccagcagcacccggcgcgaggccagcgacccggtgcggcacagcgactgcgcctcggcgaaatcctcgaacgccgcggtgtaccgctccaccgcggtccggtaggcgccccgcgccagcagcacgtccgcccgggccgccgcacccaggtgctgcgccgagtcgaccgcgatccggaacccgtccagcacctcggccgccggcacgccccgcggcgcgcagccacccagccaggaggcgatccgggtgatcagggcgtggtcgccgcgctcggcggccagccggatcacccgcagcagattgccgtactcctcccgcacccacaccttggcctgcccccggccggcgacccggtgcgcgaaccgggcgtcggccggcagccagcggaccggcgacgccggccgggcggccgcgaacccggcgtccagctcccggatcacccgctcggcggcctccaggtacgcctcgtcgatgcgccgccgcgccccgtccgggtcgtcgcccggctcggccagcgacacggccagctgccgggcgatcggcggcagcgcgtaccggtcgatcgcggtcacctcgtcccggccggcggccagcaccagctgcgccgaggccaggtcggcgatcaggctctccgcctcgggcagcgccacccccgaggcgggccgcaacacccacggcacgaaggtgtccgagccgacgaacgacagcaaccggaacgccttctgatggtccgggccgagcgccttgtactggccgctgaggcggtcgtgcagatcccggctcggcgcccggagcacggcgcgcagaccgcccggctcgcgcagctcgtcggcgagcgcgggcagcgacatccggcgctgcgcggccagatcggcggccgcccgcagggccagcggatgcccgccgcacgcgtacacgatcgcggtggccgcgcccagatcgaacgggacaccgtagccgagcaccgcggccagcaggtcgatgccgtcgtcggtggacagcggccgcaactgcaacgaccgcgccccgaacgccgggctcatgtcccgccggctggtgacgatcaccgcgcaccggctctcactgggcatcaggtcgcgcagctgggcctggtcgcgggcggcgtccagcacgatcagcatccgcttgtcccgggtcagcgtccggaacagccaggcccgctcggcggtcgaggtcgggatccgctcgacgtcccagcccagcgcgggcaggaaactgtgcagcacctgggccggggaccgggaggtgccggccaccccgaggttggcgtacaactggccgtccgggtaatcctccttcagggcgtgcgcgagggactgcgccaccgccgtcttgccgatcccggccatgccgtgcaggaagatcagcaccggcgcctcggtctggctggtgcgctgccgctcccgccaccggtcgtgccgctcccgcagcgtgctcagctcgacggcccggccccggaaggtgctgttgcccggcggcagctgggccggcaccggctggatcagcgcctcgctgtacgacttccactgcgccgccggcgaatcggcctcccctgcgtcggccggccggcccggccgggtggcggcgaacctagctagctagccgcgcggcaggagcgagcgggacagccgggcccggcgctgctgaaagtgggtgaccgacacgtcaccacccgaccgggctggacggcgcgatcggttccacccggcgtggcgcgccaccgccggccatccgacgcaggcgggccccggtcagacgcagcgaggtctgccagtaccgctgcccggtcttgagctgcttggcccggcgcagcgcgtccgccgccgcggccagcgagccctcccggagatgcacgctggccaactcggccgcggcgtgcccctcgatgaaccggtccccgcagttgcggaaggtctccagcgcgtcctcgatcaccgtgcgggccgccgcgtactgcccggcgtcggcgtggatccggcccagcaacaggcgacagtggccggtgccgtagcggtgccggatcccggtgaacccggcgagcgccgcgatcgccagatcctgggcgcggaccgcgtcgccggagcggacgtgcagttgcgcgtcccggtagtcgacccactgccgccacaaccggtacccggcccggtcggccgcggcgcgcgcgtcggcgaaccgctgctcggcctcggcgtaccggctcaatttgatcagtgtcatgccctcggccagcagaatccgcgaccggtagcggatgccgccgtcgcggcggccctcggccagcgccatggcgcggccggtgtgctccagcgcctgagcggcccggccgccgagccggtgcaccagggccagctcggtcagcacccggatctgctccggctcgtcaccggcctgcccggcgtggcgcagcgcccgggacaggttgcgctcggcgacgtcgagctgccggacccggcgctggatgtggcccatcacccggtacacccgggcccggatccccggatcctggtgctgccaggcctgctcggccaggtccaccacctcgtcggtgccgcccagctcggcgcgcagctcggccagcgcggccagcgccttgccgactcctggctggtcgccggcctgccgggcccggtcgagcacctcgcggacgttgacgtcggccgccaccagactgcccttgtccagcaggtcataggtgtggatccgctgctcgtccagcggatcgcgggtgcgcggccgggggtgcggcggcgccggacggtcgccgccggcccgcagccgggcgaaatcctgcacgtgctcgaccgtctcgtagaccggcacgccggccgcgtcggcggtccaccgctcgacgaactgggtggcggacaggcgatcggccagcgaccgggcctgatcctcgtccagattggtctccgcggccagcatccacggctcgaagcgacgggacagccggcccaggctcagcacggcgtcccggtcgccgcggctgagcagctcgtagctgacgttcagcgcccaccggcgcgggtcatgacccggctccaccgaccgcggatcgcggccccgctccgtcggccgggagtcaccggacgcgacgtcggcgcgggacaggaccaccgacatgtccgccgacgggcgggccaccagggcctggccggcgatctgcagggcgagcggcagcccggcgcaggcccgggcgagtgcggtggcggccggcagactgtcgcggacccgctgctccccgacgatctgggcgagcagcgcgaccgcgtcccggtcggccagcggctccagcggcagcagcaggtgcggcgcccgcccgggccggacctgcggcgaggtgagcagcacggcactgcccgcgccggccgggatcagcggctgcgggtccagcccgtgcacgtcgtcgagcaccaccaggagccgtttgccggccgacatccgctggaactcctggcggcagacgtccagcccggccgcccgctcggccgggtgcccgagcgccagcaggaaccggatcagcgtgcgacgcaccatctcgtcggggtcccggccacgggcgtccagggtggcgaacagctggccgtccgggtagcgggcggccacccggtgcgcggtgaacagggcgacggcggtcttcccgatcccgggcgcgccggcgatcaccacggtgcgcaccgccggaccggtcgcggcggacaggtaggccaccgcctcgccgacccggtcggcgcggccgagcagcagcggcgggacggccggcagctcccgcgggaccagcgggaccggcgggcggggcccgtcctgccggctgacgacgacggccaggccgatcccgagcacgccgaccagatagccggcgaacagggcgagccaggcgaacaggccgtcgctgtgcgccgaggcggagacgatccgggcgaaggccaccggcatcacgacgagcgtgaccgcgccgagccggcggatccacaagcgaacggttcccggttcccggtgcaccacacctccgctccgcgccgacggccgctgccttgatgtcaggatgcccgagtcgggccgggcaatcgagggtcggtcaccttccgtacgcgaagttggcattcccgcgcctgtcccgggttgcgctgcggtagtctcgcgacaagggggtgggccagccggaatcgcgctctgccacggtgttcgcacggaacgcggatcacccgatggacggacgtccggtgtcggcaatccggcggtgcccgactgcggtgcgtgaccgccaccgccgcccgctccggacccgttccccggggcggccggtgcacccggttcccgagctgcgggaagcggccgccggggcggaccggcgggtcggtagtgttcgagcgaccagcccgccgacagattgccctgacaccgtgacaaccgccgcactctccaccgacctcgtccggagcctgaaccaggccggcgtcaccgatgtgctgaccgacccggcccaccgctcggcgtacgccagcgacgcctcgctgtaccgggtggtcccgcgggcgatcgtccggccccgccacgacgaggacgtggcggcgaccctgcgggtgtgccgcgagcggggcgtcccgatcaccgcccggggcgccgggacgtcggtggccggcaacgcgatcggccccggggtgatcctcgacttcagccggcacctgaaccgggtgctcgaggtcgacggggacggccggtgggcccgggtgcaggccggcacggtgcaggccaccctgcaggccgcggcgaaaccgttcggcctgcggttcgggccggacccgtcgacccacacccgctgcacgatcggcggcatgatcggcaacaattcgtgcgggtcacggaccttgggctacggccgtacgtcggacaacgtcctggccctgaaggctctgacgatcgacggcgagcagctggtcaccggcccggtcaccaccggcgccgacaagacggtcgccgccctcaaggacctgatcggcgcccacctcgcggtcggccgcaccgagttcggcaccttcggacggcaggtctccggttacgcggtcgagcacctgctcccggagaacgggttcaacctcaccgagttcctggtcggcagcgagggcaccctcgcggtggtgaccgaggccaccgtgcggctggtcgccgacccggtgcaccgcaccctggtggtgctcggctaccccgacttcggcaccgccggtgacgtcatcccggccatcctggagttcaagcccaccgcgtgcgaggggctcgaccaccggatctgcgacgtggtccgcagccgccgcgggccggacgcggtgcccccgctgcccggcggcgccgcctggctgatggtggagatcgccggcgacgacctcgacgaggtccgcgagcgggtggccgggctggtcaaggccgcccaggcggtcgattcgctgatcgtcgaggacaccgcgcaggccgccccgctgtggaagatccgcgaggacggcgccggcctggccgggcgcgctcccggcgggctgccggcgcacgccgggtgggaggacgcggcggtcccgcccgcgagaatcggggcatatctgcgcgacttcgacgcgctgaccgcgcggcacggcctgcacgccatgccgtacggccacctcggcgacggctgcgtgcacgtccggctcgacttcccgctcgacaagccgggcggaccggggagattccgcgcgttcctggaggacgcggccgacctggtggtgagctacggcgggtcactctccggcgagcacggcgacggccgggcccgcagcgaactgctcagccggatgtactcgcccgccgcgctggacctgttccggcggatcaagcacaccttcgacccggacaacctgctgaacccgggcaacctggtcgaccccgacccggtcgacgcgaacatccgggtgtcgcaggcccggccggtcaccacgaaactggcgctggcgtaccacgccgacggcggcgacttcaaccaggccgtgcaccggtgcaccggggtcggcaagtgccgggtcgacaccacggtcctcggcggcgtgatgtgcccgtcgttcctggccaccagaaacgagaaggactccacccgcggccgcgcccgggtgctgcaggagatgctcgacggcgatctcgcccccgactggcgggccgaggccgtccacgacgccctcgacctctgcctgtcctgcaagggctgcgcgtcggactgccccaccggcatcgacatggcggcctacaagtcggaggttctgcaccagagctaccggggccgcgcccgcccgcgctcgcactactcgctgggctggctgccgcgctggtcccggctcgcctccagggtgccggccctggccaacctgatgaccaacctgcccggcatccggcgcctcgcgctgtacgtcgccggcgtcgacgcccggcgctccatccccaccttcgcggaccgcacgttccgctcctccttccgcggcgtccagaccggcaagccggtcatcctgttcgtcgacagcttcaccgaccacttcgccccggacatcgcccgggccgccgtcgacctgctcaccgacgccggctacgccccacgggtgaccagccgcacagcatgctgcggcctgacctggatcaccaccggccagctggacgccgcccgccgcatcctcggcgccaccgtccacgaactgcaccaggccgtcaaacagggcatcccgatcgtcggcctggagccctcctgcaccggcgtcctgcgtcaggacgccgtcgaactcgtcgacaccgaggccgcgaaggaggtcgccgctgccacccggacggtcgccgagctgctggccgccacccccggctggaccccgccctcgctggccggggtccgggtcatcgcccagccgcactgccaccaccacgccgtgatgggctgggaagccgacgccaaactcctgaagagggccggcgccacggtcaaacgcctgggcggatgctgcggcctggccggcaacttcggcgtcgaacgcggccactacgaggtctccgtcgccgtcgccgaacagcagctgctgcccgccctggccgcggccgaggagggcgacatcttcctggccgacggcttctcctgccgcacccaggcggacgacctggccaaggtctccggcctccacctggtccagttgctcgccgacgcgctccccgccaaccgctccgctgccaccaccggcgactccggcaccggccttgccggcgcgggtgactccgctccgggcgcccccgctccgggtgcctccgctccgggcgcctccgcctcgggtgcctccgctccgggcgcctccgcctcgggcgcctccgccccgggccacgaagctcgccttggggacgaggagtgaccggcgacatccgctcgttcgagggggccgactacgagccggtcgccgcggtgtgggcggcggccggggcgggcgtgctgtcccgcgacgagctgacgcggaaactgacccgcgacccggacctgttcctggtcgccaccgacggcccggaactgaccggcgccgtgctgggcacctgggacggccgccgcggctggatcttccgcctcgcggtccacccggaccaccgccgccggggaatcgccaccgccctggtccgcgaactggagtcccgcttccgcgccctggactgcccacggatcaacctgctggtcctgcccgacaacgaggccggtctgcgtttctggcaggacctcggctacctgcccgccccggacgtcctctgcaccaaaccgctctgaccaccaccgccggaaaagccgattccccgacgacaccctcggccggcaccagccgacgacacccggcgcgtgcggcagccgggtgccgaggtgcgcgatgagcagcagtgagccgggtttcgagggccgggtggtggggggtgtggcgcgggcatggtcgaatggggcatgctgctcgccccgttgcttgtggccgcggtgaatgcggcgccggtctgcaggatcgccgacaagcggatggacgagctgtcggggctggtcacgaccgccgacgggtatgtcgtggtgaacgacgggtcggatgaggcgtcgcaccgcaggattttctacctgcggaaggactgctcggtggcccgggcggtgtcctatccgtcccgtccgcgggacaccgaggatctgcaactgggccgggacggcatcctgtgggtcgcggacatcggcgacaacggccgttcccgggacacgatcgccctgtggcggctgacccccggctcgtcgaagccgcaactgctgcggatgtcctacccggacggcgcccacgacgcggaagctctgctgatcacggccgagggcagcccgatcgtggtgaccaaggagcccggagcggccgggatctacgtcccggacggcggtctgcgcgccaccggcaccacccggctgaagcgggccggtgacgtctcggtgccgttcacctcgaccagcaacccgttctccctggccggccgcctgctgatcaccggcgcggcgaccagcccggacggctcccgggtggtgctgcgcacctacgccgacgccttcgaatacgacgttcccggcggcgacgtcgtcaaagccctggtctccggcacaccccggcagattccgctcccggacgagccacagggcgaatcggtcgcctacaccaccgacggcaccgccctgctcaccgtctccgagggtgcgaaaccgcccatcctcagacacccgctgcccgacactcccgccacaccccgctcccccgcgtcgtcaacagccgaccaggcggccccgtccgccgccgtcccacccgccgccgccgaagcggtccgggcaacaccgaagagctcctcctcccgcctccccctggtcctcctcctcatcgccgccaccgccctctgcctcgccgccgccatcgccgccgcccgccgccgcaagcgctagccggaagttcactaccgcccgccgccgccaccggccgcaaggccacagccgggcggccagggtgacgaccgaccggacgtacgaatcgatgccggccactccgctcaccgtgggcagtcctggtggtgccgggggcggcgctcggtcgccgaaggtcccggtcgcggccgcgatgggggcgctcggtctggtcgtggcggcgcggcggtgggtcgtacgccagctagttaatcttgaaaagggaccgcgcgaccctggggccgcgcggtccgtgagaggtcaggccaccgtggccgggaagcgttcccacacacggtggttggccatcagctgctgcagcgcggtcagcacctcggtggccgagtcgccgaccaccacgcccggcgtgtcggccaggccggttcggcgcagcaggtcggcgccggtgccccagccgccgatcgccttggcgtgccgccacgcctcgtcgaccagcatgttcacccgcgggtcgacggccgcggtgcgcggcgcgccggccttctcgtcgcgggccggcaccgcgtccggcgccgggaccggggcggccgccaccagcaccgcgtcgtactcgatggaccgcgcggtggcgaaggtccgctgcaccgtcaatccgccgaccttgccgccgtgcggagcgatgatcagcgggaccatgccggcggcggcgatcgcctcgcggatctcggccaccgcggcgtcgccgccggtctcgtcgaccacgatgccgacgatccgcccgtcggccggccactgctgaccgatctgggacagcgcggcgctcggcgtgacctcgggcaggtcgatcgacggcgccggggcgggcagccccaggccgagcgcgacctgctcgcagagcaccgggtcgatgttggccaggcactgcagctgccgttccttgatcgcctggtggtagcacttgccgagctcgaaggtgtaggcccggatgatgtgctcacgctcgaccggcgtcatgctctgccagaacagccgcacctgggtgtagtggtccttgaacgacaccggcaggtcgcggatcttgggcgcctcggtgaccaccacgggcacatcgacgaagctgccctcggtggtggtgaacgggttgccgccgtccagcgagttggggcggtagggtgccacgcccgcgtgcaccgcgtgctggtggaagccgtcccgcagcatgtcgttgaccggggcgtgcggcgcgttgatcgggatctggtggaagttcggcccggccagccgggtcagctgcgtgtccaggtaggagaagagccggccctgcagcagcgggtcgttggtcacgtcgatgcccggcaccaggttgcccaggtggaaggcgacctgctcgacctcggcgtggaagttggtgggcgtgcggttgaggaccagcttgccgaccggctgcaccggggccagctcctccggcacgatcttcgtcgggtcgagcagatcgatcccggcgaacgtctcctccggattgtccgggaagacctgcaggcccagctcccactccgggtaggcgccggcctcgatcgagtcgtacaggtcgcggcggtggaagtccgggtcgacgccgttggtgatctgcgcctcctcccagaccagcgagtgcacgcccagcttgggtttccagtggaacttcaccagcacggtctcgccggcgtcgttcaccaggcggaacgtgtggacgccgaaaccctccatcgtccggtacgaccgcggaatgccccggtcggacatgttccacatggtgtggtgctgtgcctcggtgtgcagcgagacgaagtcccagaacgtgtcgtgcgcgctctgcgcctgcgggatctcccggtccgggtgccacttggcggcgtgcacgatgtccgggaacttgatcgcgtcctggatgaagaacaccggcatgttgttgccgaccaggtcgaaggtgccctcgtcggtgtagaacttggtggcgaatccgcgggtgtcgcgcaccgtgtcggccgagccgcgcgagccgagcaccgtggagaaccgcacgaagacgtcggtctgcttgcccttctccttcaggaagccggcctgggtgagcgccgccgcggtgccgtaactggtgaacacgccgtgcgcgccggcgccccgcgcgtgcaccacccgctccgggatccgctcgtggtcgaaatgcgtgatcttctcgcggaagtggtggtcctgcagcagaatgggtccgcggggcccggccttcaacgagtggtcggtgtcccgcaggcgggcaccctgcgcggtggtcagataaggaccctgctggccgtacgccgtcggcggcgcaccggtgggcgcgccggtcggggtgcgggtgtccggctggccctgctcgggtttgggcgggaggggctcccgcggcgtggccggctcctcgaccgtgggcgtgccgctgcccggggcgcccggcacatccggcttcttctcgctggtcaccgcggtgacggcatccttgatcacttcggcgggactacgcgcttccatccggacaaactcctcgataagggtatgtgatcggatggcggataccccgcatgaaccccggcaaacggtccggccgagcatcggcccggcccggacggcgtctcgcggacgcgtcacgacgaccatccggccctgttcgtggccgacgatcgggtcggtccggacgtcggtggcggtcccggttttgtcgtacccctccagtatcaaggtcactgtcacgagagcccgacgaaacgagtgcctgatgcctaccgagcccgagatcgcccccgtcgtcgacgcggcgcacgccgagccgttcgacaccgccgcggactaccgcgcggcgatcgagcggatccgggcggccgccgcggcctactacgcgggcaccgacctggccatggacgacgccacctacgacgcgctgctggcccgggtcaccgccaccgaggccgcgcgacccgggtggacggtcgccgagtcgcccagcgacacggtcggcgccggcggcggcgtcaccggcgacgtgcagcacagcaccccgatgctgagcctggccaacgtcttcgaccccgacgagctgctcgcctgggcggcccggctggaccgggtcctcggccggcccgccgccggctacaccgtggagccgaagatcgacggcatggcgatcgccgcccgctacaccgacggccggctggtccaggtcgccacccgcggcgacgggcgggccggggaggacgtcaccgcccaggcccggacggtcgccggcctgccggccgagctgacccggccggtcaccgtcgaggtgcgcggcgaggtgttcatgaccgatgaggacttcacccgggccaacgaactgcgtaccgggcacggcggcgcaccgttcgccaacccgcgcaacgcggcggccggcacgctgcgcgcgcaggaccgggcgtacgtcgcgccactctccttcctagcgtacgcggtgcacgacctgcccggcggcgagggcctcacgcacagcgcggcgatggcggcgatcgccgagctcggggtggccacgaccggtggctcggcggccggcatggcggtctgcgccaccgccgacgagctggtcgcggcgatcagccgcctcggcgcgctccgcgacaaactcggcttcgacatcgacggcgtggtcgtcaaggccgactcccccgccgaccgggacgccgccgggtcgtccagccgggcgccgcgctgggcgatcgcctacaagttcccggccgacacccgcaccagccggctcaccgcgatcgaggtgcaggtcggccggaccgggctgatcaccccggtcgcggtgatcgagccggtccaggtcggcggcgtggtggtcacctcggccaccctgcacaacttcggcgacctggtgcggcgcgacgtgcgggtcggcgacacggtcttcgtccggcgggccggcgaggtgatcccggagatcaccggggccaaactcgacgagcggcccgagggcgccgagccgttcgccgcgccggagcactgcccgcgctgcggcggcgacatcgaccggtcgcagaaacgctggcgatgcgtgcagggccgggcgtgcggcgccaccgagtccctggcgtacttcgcggcccgcgactcgatggacatcgagggtctcggcgacaaggtgatccgcgcgctggtcacggccggcctggtcaccgacccggccgatctgtacgacctggacgccgacacgctcgcccggctcgagcgcctcggccgcacctcggcggcgaaactggtcgccaacatccaggcctccaaacagcagccgctgtcccgggtgctgaccggcctcggcgtgcggatgaccgggcggtcgatgtcgcgccggctggcccggcacttcggcaccatggaggcgctctgcgcggcgaccgtcgaccagctgcaggaggtggcggcggtcgggccggaacgtgccgccaccatcgcggccgagctggccgacctggcgccggtcatcgccaagctcaccgagcgcgggatcacgatgagcgagccgggagtgacgccctaccacgagcgggtggtggcgacggcagagaccgggctgccgttgcagaaggaggacggcacgccgatgacggtggtggtgaccggatcggtgccgggcctgacccgcaacgagggcaacgaggcggtggaacgcctcggcggcaagtcgtccgggtcggtgtcgaaacggaccgacctggtggtggtcggtgacggcgccgggtcgaaagcggcgaaagctgaggagctgggggtccggatcatggcgtcggaccggttcgcggcgctgctcgccgcgcacgacgccggggaggcgccggcgctcgacgactactgatccgcgacgaccggcggcgcgcgcgggcaagcagcgggcgggcaagcggcgcgcgcgggcaagcgacgggtgcggatgccggtcgcccccggcccggcgccgcgctggggtgggccggtcgggggcggtggctgtctccggtgcggtggctaacggcgggcggcgatgatgcgggccgtcacgccggtcaggatcatggcggctccggtgatcagcagccagatgacggccggcccggtggtgggcagggtcggtgtctcggtggcggtcttcgcggcggccttcacgtcgaggcggcggaccagggcgttaccggacttgtcgacgccggaggcgacgatcgagtggtccccgatcggcaacccggacgggatggtgaccgtcacgctgatccggccctgggcgtcggcggtggccgtgcccaggttcagcggcgaggaatagatgatgacggtcaccgtcgagaacggcgcgtatccctcaccggtgatggtcaccgtcccgcccggcgccaccgtgttgtcggtgccggccggcgtggtgagcgtcttgtcggtggtgggcacggtggccggcacttccggcgcggacggggtcaccccgttcgacgacccggacgccgccgactcgccacccggacccaccgcggtcaccgtcaccgtgtaggaggtgcccgccgcggcccccatcacacagctggtgccgctcgagctgcagctacccgggcccgggctggcggtcgcgcgatatgaggtgacgccggtggtgtcggccggtggattccagctcacgacgatcgacgagatgcccgcctgggcggtgaccccggacggcgggccggccggcggcggcgccacgctcggactcgcggacggcgacgccgtaggagacgcggacggcgacgaggtcggcgatgcggacggcacggccgacggcgaggccgacggggacggcgtgggtgagggtgacgcgggcgccgccgccagggtcaccacgacgtcggccggctctccgggccccaccgggttcaccgcccgcggtaacggtgcgattcaggcgttggcccggtaaaaggcgtaccgcccgatcacccgccccgcgcccctgccggtatgggccggatcggtcagcccggccgaccgcataaggtccacaatccgctccggagtctgcccggcgagccgcagcgacagtccgtgcgccgcaccgtcggcatccaccagatgcagctcgccgcccggccgcaacacccgccgcacctcccggaacgccgccgactgcgcctccggttccaggtggtgcagcatgtagcaggacagcacccggtccacgctcgcatccggcagcggtaggcaatccgcgtacgcctgctcgaaacgcacctcgacaccacgccgcgccgctttgcgtcgcgctttgcgcagcgccgccggatccggatcgattccggtcagatcggattgcggcgtacgccgcgccaacgccagcagcagatcacccggcccgcagccgatctccagcacccgctgccccggccgcgccccggcccggtcgaggagttcggcgtgcacccgccggagcccggccacccgggtgaacggatcgtagaggaacagcatcccgtgccgccccatggccggaatgtagggccgcgtggtctcggtcatcaccgtgctcctgtcgcgatcggacgattttcggtcgtacgctcagcctcatgcaggccagcgtcggggacatcgtcggatccgtggcagggataggacattcttcggttccgcatagccaggcggcccggatggcccggaccaccgccggtggggtgccggtcgccgtcttcgagcgcgcgccgggcgtcccggcggtggccgtgtcgcggctgcccgacgtgccgctgaccgcggccgtgctgcccgggcggcgcacccacacgcacgacttcctggtccttttctatgccgcccgcgcggccggcaccgtcgtcatcgatgaccggaactggtcagttgccgacggcgacctgttcgtcatcgcgcccggccaggtgctgtccttcccggagccggccgacgggatggtcgccgacggctgggtggtcttcttcccggccgacgtgatccgctccggcgcctgttcgtcgtggcgcgcccacccgctgctgttcccgttcgcccacggcgcgcggcgcgcccagcgcctgcacctgccacccgccgaccgcgacggctgggtcgccggcctgcgcgccctcgacgccgagctgcgggccagggcgagcggtttcgccgaggcggccctggcgcacctgaccctgctgctggtcgcggtcgcccgccgctgcaccggcgtcgccgaggaaccgttgatcgccgccgtgctcgacgtcgtcgagcggcgcttcgccgagccgatctcgctggccgacgtcgcggccgagctgtccctgaccccggggcatctgaccaccgtggtccgccgccgcaccggccgcaccgtgcagcagtggctgggcgagcgccgcatgcaggaggcccgcctgctgctgaccgacaccgatctgacggtggcggcgatcgcccaccgcgtcggctacccggacgtcagctatttcatccgccgcttccgcaccgcgcacggcctgaccccgtgccgctggcgcacctacccggacccaccctgaccctcagcccaccgccgcacacacccggcaatgctggccgcgtaccggggactcgctccgaaaggcacggcctgaagcgccggcggtggcggaccgccgggtccgccgcttgcgacggaccgcccggttcgccgtcactcggcagaccgcccggtccgccggcactcggcagtccgcccggtccgccggcatcccacgaaccctgcggtccgccgccacccgacgaaccgcccgtgcgtcgccatccggcagaccatctggtccaccggcgccgccagcccggtcaggcgaggtcgcgcagcacccccacgatgtgctgctggtcctcgtcggtcacccggtgatgcagcggcaggatcagcgagtcccgggtgatccgctcggtgaccggcagcggtcccggcgtcacgtcggcgtaggccggctccaggtgggccgccatgatgccgcgccgcgccgacaccccgcgccgggcgagttcggccagcacctcgtcccgtccggtccggtacggcgggtcgagcagcacccagaacgactggtagttggtctggccgtgggccgggtcacgcaccggcaccaggccgtcgatgtcggccaacagctcgtggtagcgcgcggcgagggaacgccgctgcgcgaccagaccggcgagccggccgagctggaccaggccgaccgcggcctggatgtcggtcatccggtagttgtacgcggtctccaggtacgcctcgaggaccggctggctgctggagtgccgatcggccgcggacacgttcatcccgtgttcgcggagccggcgcagccgggcggcgacgtccgggtcgtcgacggtgaccatgccgccctcgccggtggtgagcaccttgcgcgggtggaacgaccacgcggcgacggccgcgccggtgccggccggtgccccgtaggcggtggagccggcggcgcacgcggcgtcctcgaccagggccaccccccaggcttcggcggccttgcgcagcgcgaccgtgtcgaacggcaccccgccctggtggaccgcgatgaccgcgcgggtgcggtcggtgcggaccgcgtcgatcgtctcgacggtcaggttgccggtggccaggtcgacgtcggcgaagatcggcgtggcgccgacgtagcgcacggcgttggcggtggcgatgaacgacagcgacgggacgatcacctcgtcgccggggcgcaggtcgagcaggaccagggccaggtgcaggccggtggtgcaggagctgaccgcgaccccgtgcgccgcgccgacggtggccgcgaactccttctcgaaccgggcgacccgcgggccctgggcgacccagccggagcggaccgcgtcggcggcggcctgcgcctcttcctccccgagcatggggatcatcaccgggatcactgggaggaccgccaccagtcgacgagctgctgcaggccctcgtgcaggccgatctcggcgcggaagccgatcacgtcgtaggcgcgctgggtctcggccaggcgccgggtgacgccgttgaccgcgcgcgccgggccgtgctccggctgcaggtcggatttcatcaccgcgctcagcgcggcggccagctccttgaggctggtctcggcgccggaggccacgttgaacacgtcgtcggtgacatcggcctgggcggccaggatgttggcccgggcgatgtcggccacgtgcacgaagtccatggtctgcaggccgtcgccgaggatcagcggcggggtgcccgactcgatccgctccatccagcggatcagcacctcggtgtacaggccgtggatgtccatccgcgggccgtacacgttgaagtagcgcagcgcgacgtagtcgaggtccttcatcgccttgaagctgcgcagggtggcctcgttgaaggccttggctgcgccgtagaacgtgtcgttgttgtacgggtggtggcgctcggtggtcgggaactgctcggccaggccgtacacggaggccgacgaggacgcgatcaccttcttgaccccggcctcggcggccgcctcgaccacgttgaaggtgccgtcgacgagcacctcgttggccagccgcggctcctcggcgcactgggtgatccggatcgcggccaggtggaagaccaggtccttgccggcggtgaccgagcggaccaggtccacgtcgcggatgtcaccctcgaccagggtcaccgggccgttctcgatggcccaggccaggttctcccggcggccgcggacgaagttgtccaggacgacgatctcggcggccccgccgcggacgagttcgtcgaccacatgcgacccgatggtgccggccccgccggtgaccagggcgcgcgcgccctcgatcgatactgccgtcacgccatgtgcccttcgtcgatcgtgatcatcgtgccgccctcggtgaggctacgggaggcggcctgcagcagctgcagcacccggagcccggagcggccgtcggtgagcgcgggggtcttggtggtgatcgcccgcgcgtactcgtccaccatggtgcgcagcgcctcccgctcggtgagcgccggcgcgaccatgtcgccggagcggtacgagatgaggatgtcgcggcgctgctcgtcgccgagctcgtccggggaggccacgtcgacgccccggtcgtagatggccagccgctggctggggttgaggtcgtcccacaccagggtccgcttcgagccgccgaagatcgcggtgcggatcttcaccggggacagccagttgacgtggatgtgcgcgatcgcgccgttgctcagctgcagcgtgagataggccacgcaggcccggccggcgccgatcccgtccgcgccgtgcgccgcgacggccaccggggtgacgccctcgggcagcacgaagtcgaggatggacaggtcgtgcggggcgaggtcccacagcacgtcgatgtcccgctggaccaggcccaggttgatccgcaccgagtcgaggaagtgcagctcacccagctccccggcgtgcagcagctcacggatgcgcagcaccgcgggggtgtagcagtaggtgtggtcgcacatcagggtcaggccgcgctcgtcggcctcctcgacgagctggcggccctccgcataggtggccgcgagcggcttctccaccaggacgtgcttgccggcgcgcagcgcggacagcgccaccttgaggtgggtgccggccggggtggcgatcgccaccgcctgcacggccgggtcggccaggatctcttccagatccgcggtgacccgcaccgtggagtatccgccgaggacccggcgggcccggtcggtgtcgaggtcgcacaaccagtgcagccggaactgggggctggcctggaagttgcggacgaggttggggccccagtacccggccccgatgacggcgatcccgatcggctcggacgcgttcaactgacttccgttctgtgtcagggcaaatctgtgtcaggtcagcaggactcatcaaacccttggcaagctatcgatccccttaggagcgacgctagatcgctgtcggataaccgcgcgcccggagggcaagccgatccgttcggtcgttccgggtcgccccaacggtcacatcgccggcccgcgtcgccttcccgacatcgcttcgggaggccctccgctaccctgtccgcgaccttacgtgagaggcgtttcatgactgacgtgaccgtggccgcgacggccgatgtggacccgcgcgccgagatcggcgagggcacccggatctggcatctggcgcagatccgcgagcaggccaccctgggccgcaactgcaacatcggccgcggagcgtacgtcgggcccggcgtcagcatcggcgacaacgtgaagctgcagaaccacgcgctggtctacgagccggccgtgctcggcgacggcgtcttcgtcggcccggccgcggtgctgaccaacgacgagtacccgcgctcggtcaccccggacggccgcctcaaggacggacacgactggaccgcggtcggggtcacgatcggtacgggcgccgcgatcggcgcccgcgcagtctgcgtcgcgccggtcaccgtcggccgctgggcgctggtcgccgccggcgcggtggtcaccaaggacgtgcccgatttcgccctggtcgtcggagtcccggcgcgccggatcggctgggtcggccgggccggcaaaccgctcaccgcgaagggcgacggcatctgggtctgcccggccaccggcgcccagttcaccgagaccgacggcatcctgaccgaaaacgagatctgaaaaccatggcttcgtacgacgcggaactgatcgtggctacgccggagcgccaccccgtcgtggtgggcggtaccccggcgtagcggctatttctccccgatcgccagcaggttgaccaggaaggcgacggtggccggcgccggggtggcccgaccggcgagcacctcgccgagccaggcgtcgcggaccagcccggtgtcgcgcagcggcgcaacactgtccggttcggatcgccagtgctcgaccaccagggcggccatctcgccggcacccagctgcgggcgcccctggccacgcaccttctgccggatcttgcgggccgccttctgcgcggtcacccggtaggccgcggtgcgcgccgccagtcccggtctgccgagccggttcgggatcagcccggagtcgaggggcaccgcggccagcgccgggtcgagcaggctgatcagccggccggtgagcagcccgtggcgtttctcctcgggcctgaccgcgtgcgccagctggatgaaccgtcggtcgaacatcgggttgacgaagtgccggttggcggcggccaccgacccgtgcgcgcccgaccagcgctgcatccgctgatacaggtagaagtggtcggtcgcggccagccagtcggtggggtacccgtcgaacgacgcggtgatcagctcgagggcgtcggcccgggcggacgccgcgaagtcgggcgccagggcctcggactgcaccgcctcgttggcgtacagccgccaggtggccagtttctcgatcagccgcggcccggtcgtcgccccgccgggctgcccgaagtagtagaagccgcggcacgtctcgccgcccagcccggacagccggtggccctgctccagctgggtctcggcgcgcagcagcggggccagggcgagcgggctggccatgcagtccagttcccgggcggcgcgcacggccagggcgaacgcctcggccggggtgaccgccgggccctcgtccatccagtgcacgtgcagtttcatgccggtcatcgcggcgagccggccggcgaaccgggagtcggtgccgccgtgcacgtccagggtgagcgcgggcagcccggcgcgcagcccggccgggatcgcggcgagcagcacccgggtgtcctgtcccccggtcagctgcagcaccgaacgcgggtggtcgcgcagatacgcctggtggaatgcggtcatgatggccgcctgttcgacggccgcctcctcgagcgagggggacgggccgtccacggcgagggactcctcgacgtaccggtgaatcaggatccgaccgtcgtgcaggaccgcgaggcagccggccgggaccttgtgcacgccggcgaagaccgtgcgcaggccgacctgccagccgaccaggctctgcacggcgagcgccggccggtcgagatcggcctcggcgagcgcgcgcagcgcgagagcactggtggagacggccgcgacgccccggccctgccaccagaacagctggcggaagccgagccagtcggtggccgcgatcaccggcgcggcggcgccctcgctgtgcgccgcggcgaacggcgggaccagcgcggccagcagcgggccgtcggccttgacaccgtcgcgcagcagcacgccgagggcctcggtggagacgtcgccggtgcgggtgcgggcggccttgccgaggcggacggtgaacgccccgctgtcctggtcgatgcggtcaccgtggtcggcgccgccggtggcgacccagccggtggacgtgcgggtgaccaccgggtcaccgctgaggcaggccaggaccggggccggggcgaccggcgcgagcgcaccggaaaccgcgaggaacgatctcaccgaagatttcccgtcatgcggccaccctatcgtccacatcggccctgcgaaaagcgccgctgcctcggcgaaaaccgacattagacccgcatttcccgtacgacgtctgtcattcttccgacgagctggagaattgctcggcgggcgtggtttactcccctgatgcgggctccaatctggacgcggcgatcggtcgacgaggcgttctccgctccgggcaacagtttcggtttccttcgtctgctgttcgccttcgcggtgctggtctcccattcgctgccgctgggttacgggcgggaggatccgggcggcgggctcacccacgggcagaccgtgctcggcgagatcggcatcctcggcttcttcaccatctccggtttcctgatcacccgcagcgccggccgggtcccgctcccccgctacctgtggcaccgcggcctgcggatcctgcccggcctgtgggtgtgcctgatcgtcacggcgctcgtggtcgccccggtggtcgcgctgatcgagcacggcagcgtggccggggtgttcgccgagcccggcggcccgttcggctacgtgttccacaacctggccgtcgcgatccggcagtacgggatctccggcctgctgcgcgacacgccgtacgggcggctcaccggtgagtcggtcttcgacggctcgctgtggagcctgatgtacgaggtgttctgctacttcatgatcgccgggctggccctgaccggcctgttgaagcgggcccgctgggtggtcgcggcactggccggcggcctgttcgcggtgatcgtgcacgacttcctgaccgcgccgcgcatccccggcccgcagggggtgcacggcccgttcctgggcatcggcgggatcgacacgtactcgctggtctatctgacctacgtgttcctgctgggcgcgctgttcgagctgtaccgctcctcgatcgtgctcaacgagctgggcgcgatcgtggccgcggtcattctgctcggcaccacacaatgcggcggattcgacgttctcggctacccggccttcgcctatctgacgctctggctcgccattgcgctacccgccccattccggcgcatcggggtgcgtcaggactactcgtacggtttctacatttacgccttcccggtccagcagctgctcgccctgctcggcgtcccggcctgggggctgctgccgtacatcctgctggccaccgccggcacgctggtcttcgcgatcccgtcctggcacctggtcgagcggccggcgatggcgttgaagcactggtcgccgcgtcagcggaccaccgcgggcgaccaggcatccgggacgaacaccgcgggcgcgccactgccgttggccggcacggtccagacgtcgctggccgacggaccggtgcccgagcgcggcaggccgtagagcacgtgcctgtcgtccagccactcgatctggtcgtcgacgctgtgcctctcggcgagcagcgtggacctgccggtcgccaggtcgtacacggcgatcgaccagacacccggggcctggccgtggcgggtcttgaaggccacccgggtgccgtccggcgacagtgacgggcactcggcgtcctcgcgcagcgtggcgagctcccggctcttgaggctcccgcgtaccagccaggtcttgtcgccggaggcggcggtggcgtagaagacgtcgtcgtcggcgaacgtgacgccccacaggttccggttcttcgcggtggtgcgcttcccgtcgaccgacagggcgaaatccgtctccaggttcaggctcctcccgccgttcagcggcgtgaccagggtttcggtggagaagtcgcccggcgaggagtaggcgtgcccggacacgaacgtggtggtcgccacccaggagccgtccggggccagccgggcgcggctgggcaccccggacaacggcagggaccggcgcaccgaccagtccgggcccagcacctcggcccggtacgtggtgacgaaaccgacctccgccgacaggcagacggcctcgccgcggtgcgcgtacacccggtcgcaggtgacgccggtgaacgcgcgcggcccggccggggcggcgagcggcaccatggccacccggccgtggtagtcgccgatcgcggtgctgcggaacaccaggtgcggctgcgcctcgacggcggccgggtcggtcatcggaaccggtggcgcggccgcggccgcctgctcctgccggtgccgggtgcgcaggacgaccagcagcgtgccggccacgcagagcacgaggacgacggcgaacgccgccagtttggttcgcagactcacctgtcgatgcccttcagcagccatccggccgcgccgatgccgaccaccaggaaaccagccgcgatcaccagcgcgtcgcgcgggccgatcgactcccacagggcggcgaacgccagcgacacggcgaaccgggccagcaccaccacggtctgcgcggccgcgatgccgctgccccgggcctcggccggaacccgcttgctgatcagcgcgggcagcaccccgtcggtggccgcgtagtaggcgccgagcaggcccagcgcgaccagcgtggcgaccaggccgccgccggaccgcccggccaccaggtaggtgagcagcagcacggcgtgcccggcgaggaacacccgggcccggcccaccctgtcggagagccggcccagcgggatcgccagggtgaggtagacgacgttggtcccgacgtacatcagcgggaaccagcgggccgcgaactcaccgctgtgctgcagcgacaggtagaggaacccgtcgctgacggtgcacaggccgagcaggccggcggccagcagcggccggcgcagccgcgggctgagcagttcggtcaccagccgccgggccggcaggccggcacccccggtgcgccggtccggcacgaaaagcaccagcaccgtgactccgagcaggccgaacgcgaacgacgcgacgaacaccgagctgtagccgccgggtaccagcaacagcagtccgaaggcgaccagcgggccgagcgccgcgccgaccgtgtccagggtgcggtgcacgccgaaggcgcggcccagcacggccggatcggacgagtcggcgatcagcgcgtcccgcggggcggtgcggaaccccttgcccagccgatcggcggtgatcaccccggtgatcgcggcgaaggtgtgcgccgggaccagcgcgatccggctcagcgcggagatgccgtagccgaacaccgcgacccacttgggccggttggtgcggtcgttcaggtagccgccgaaaatccggaccagggcgctgacgccctggtacaggccgtcgacgacgccgtacgcgagcaggctcaggccgagctcggcggtcatgtagagcggcaggaccgcggtcaccatctccgacgagacgtcggtgagcaggctgaccacgccgagcagcaccaccgtggtggcgacccggaccttcggaccggccgccggatcctcggccggccggtcgcggagcgagagatacacgcggagtgtcagtccttcagcgcggtggcgagcgcccgcacggtcgcctcctgctgctcggtggtgatctgcgggtagagcggaagcgagaggatctcgccggccgccttctcggcgtgcgggaagctgccggccggataccgcgggtcggcgaacgccggggtcaggtgcagcgggtacggatagtggatgccggcgccgatcccggcctcgtgcagccggcccagcaccgtgtcacggcgccgcgggccgcccgggatgcgcaccacgtacaggtgccagacgtgctcgttgccggccagggtctgcgggagcacgacgtccaccccggccagcagctcgtggtagcgggccgcggcggcgcggcgggcggcgctccacgcggccaggcgggtcagcttggcgcgcaggaccaccgcctgcagggcgtcgagacggctgttgacgccgaccacgtcgtgcacgtacttctgcaggccaccgtggctgcccaacgttcgtaccagatcggcctgctcgtgatcgggggtcagcaccgcgccggcgtcaccgtaggcgcccaggttcttgcccgggtagaagctggtcgccgccaggccgtcggcgccggcgccgcggccgtgccgcagcgcgccctggctctgcgcggcgtcctcgaccaccgcgacgccgctgccggccagttcggtgcgcaaccgcgcggcgtcggccagctggccgtacaggtggaccgggacgaccgccctggtcttcgggccgatcgcggcgagcatggcgtccacgtcgaccaggtaggtcgccgggtccatgtcggccagcaccacccgggcgccgatccgggcgaccggctcggcggtgccgacgaacgtgttggccgggacgacgacctcgtcgccggggccgaccccggccgcgcgcagggcgagctcgaccgcgtcggtgccgttggccaccccgacgcagtgtgcggcgccggagaagtcggcgaactcgcgctcgaacgccgcgacctcgggaccgccgacgaaaccggtggtggccaggacccgcttgaaaccggcgtcgacctcctcggcgacctcggcgtgggcggcttgcagatcgacgagcggaatcatggtgtgtgaactcccaggggtcctggccggaacgagtcgacggacgctactaccgttcgggggtgcgggacagcgcaactgacagctatccggcaggctcgattacgtcacggcaggtcgtgatcgactcgtctactgtaatcagcgccgtatgcggcccggtgccatccgttgggtgcggcggaccggccgttcggctcgtattcgtcgatccccggcgcatccacgatggctgaaggtgtctccaatggacgtcccgccgtcggtagggtctggcccgatgggatcacccgcccccgcgagggcggtcatggggagggcacagtttgatgtcgacggcgctcgcgccggcgcggaccgggggcgacgagcggctcaccggattcgccggcgaaccgctcgcccaccggaggtaccggcgcatgcggttcatccggcggttcgaggagacgctgctccagctgttcgaagagggtgcgctcaacgggaccacgcacgcttgcatcggacaggaggccgacgcggtcgccgtcaccgagcacctggccgccggtgaccacatcttcagcaaccaccggtgtcacgggcactatctggcccactccggggacgcgctggggttgctggcggaaatcatgggcaaggacgccggggtgtgccggggcatgggcggcagccagcacatctgcgcccccggcttcaagtccaacggcgtccagggcgggatcgtgccgaacgcggccgggatcgcgctggcccaccagctcgccggcagcgacgcggtcagtgtggtgttcatcggcgacgggacgctcggggagggcgtcgtctacgagacgctgaacatggccgcgctgtggaaactgccgctgctggtggtctgcgaggacaaccggtgggcgcagagcacgccgatcgcggcgaacctggccggtgacatggccgcccggttcgccgcgttcggggtaccggtccgcgaggtggacagcaccgacgtcgaggagctcagcgcgatcgccggcgaggaggtcggcgcggtccgctcgggcaccggcccgcgggtgctgctgatccacacctaccggctgtgccaccactccaagagcgacgacgagcgtccggccgacgagatcgccgagcactggctggtcgagccgctcgtcgtgcacggccgccggctcgacgacgcggaccgcgcacggatcgacgacgaggtggagaccgcgctcgacgaggtcgtggcgacggcgagggccctgccgtgatcttcgcgaaggagctgggtgacacgctgcgcggcgcgctcggcgacgacgagcgggtggtgctgctcggcgaggacatcgccgacccgtacggcggcgccttcaaggtgacccggggcctgtccacggcgttcccgcaacgggtgcgcaccacgccgatcagcgagggcgcgatcgccgggatctccgccgggctggccctggccggataccgcccgatcgccgaggtgatgttcggcgacttcctcaccctgatgttcgaccaggtggtcaaccacatagccaagtaccaggcgatgtacgccggacaggccacctgcccggtcatcgtgcgcgccgcgaccggcgggcaccgtggctacggtcccacgcacagccagagcctggagaagcacttcctcggcgtgccgcacctgcgggtggtggcggcgtcgctctaccacgacccgcgggtggtcttcgccgacttcctcagccgggacgagccggtgctgtacgtggagcacaagctgctctacccccagcacctgacgctgccggcgggtggcatggtcggcgatctgatcgccaccgccgacgcctcccccggcatgctgccgacgatccggctgtccgcggtgccggtgcaggactgcacggtcagcgtcctggcgtacgggtatcaggcgatgctcgccgcccgggtgatcgaacgcctggccatcgaggaggagatcttcgccgagctggtcgtgccggcccagatcgccccgatggactgggcgccggtcgaacgctccgccgcggtcaccggcagtctggtcaccgtcgaggagggcgccgacggctggtcgtggggctcggaggcggccgcggtgatgtcccgccggttgttcggccggctgcgccgcccggtcgacgtggtggccagcgcgcccaccgtcatcccgtcgtccaaggtcaaagaggccgaggtgctggtcggcgccgcccggatcgaggcggccgtgcgcgccgccgcccgttaaggagacactggtgaatcccgtcctggtgcccaccaacgacgtcaacagcgaacacggcatcctggtgatgtggttcgccgaggacggcgccgaggtggagaaggatgagctgctcgccgaggtggagacgagcaaggcggtcctcgaggtgctcgcgccggtggcgggggtgctgctgcacaccgcggccaagggggccgaggtgccgctgtcgcagccgatcgcgcagctgttcggatccgccgccgagcgcgacgcgcatctcgccgcactcgccgcggcaccggccaccgccgcccccgccgggccgcgggccacggtgaaagccgtacagcgggcggccgagctgggcgtggacctggccgcgctgggcctggaccggttgatcacggtcaaggacgtggaggcgtgcgcggctccggccgttcccccggccctgctggagccgttggccggcgcgcccgggcggcagcggatcctgatcgtcggggcggcgctcggggcgacccaggtcctcgacatcctggccggcagccggacgcagcaggcggtggcgatcgtggacgacgacgcgtcccggtggggtgcgtcggtgcacggggtgccggtggtcggcggcagtgaccggctgggggcgctgttcgccgagggcgcctacgacgcggcgatcatcgcgatcggccggtcgccggccgtccgtgcacggctgcgtgccgcgtgcgcggcggccggggtgccgctggccaacgcgatcgatccgaccgcgaagatcgccaccgacgtgtcgctcgggcaggggaacatcatctgcgcgttctgccacatcgcgaccggggtgcgggtgggcgacaacaacttcttctcggcgtacaactcgttcgaccaccacagcgtgatcggggacgacaacgccagcgggccgtccgtggtcacctcgggcaaggtgaccatcggctcgcggatccgcttcggcaccggcatcttcatcgaaccggacgtgaccgtcggcgacgacgcggcgatcgcctccggtgcggtgatcgtcagctcggtccccgccgaacacgtggtgaagaccaagatcgtgacgaccaccgtcgtaccgctgcgtcgttaggtcctaaggttggatcggcaggatcgcgcaggtggggatcgacgggacaccggccagacgcagggccagccagtcgacggccgggccctggtcgaccagcagcgggccgaagtggttgatcagcgggctgatcgtcggggccaggaccaccggggcgtaagcgacgttgcccccgcgtgagcaccagttcgccgccatcgtacgggcctggccgtgcgggaccaggttgtcgctgacgccggtggcgatccggaccgcgccggccggcttgcgggtgccgatcagctgctcggcaaggaaggccttgagcaccggctcggcggccacgatgtcggcgagcgactggccgccggtcgtccacgacgtgctgcgcttcgtcgcatagccgaggatggcgtcgccgacacacatggtggacaggttcttcagcacggcgcggccgctgtcgctcagataccggtccagcagcggccgcaactccggatcggactggacgaacccgttgatcgaccagccgagcgcgccgaccagctcactgccgtcgatggcggcggtgaccgcggccaggttcgccggcggggcgccggagtaggtggcggtgagctgcacgtccggcgcgtagctggactgcagctcggcggccgaggcgaccgcgccgccgccctggctgtaaccgtagaggccgatcagcgacctcgccgacagtgaggtggccggcagggcccgggccgcccgggcggcgtccagcaccgcatggccctcgtcgacccggttgacgtaggtgtgcaggcggtcggtggtgcccagacccgcgtagtcggtctggacgaccgcgatgcccttggcgagcatccggtacatggccagcacctcgtagccgatcgagacggtgaactggttgtcctccgtgccgatgatcaggccgcgctgcagggccagcgaggtggagcactggtcaccctgccccatggtgcccggggcgaggaccaccagggggcggggcccggggccgttccaggcggcggacggctcgacgtaggcaccggtgatcgcgaccgggtgcccggtggagtcggtggacttgtacatgatgcgcgtcgcggtgccgggcagcgggccggtgatgccgggcagcgagagcgccagcgggagcggctcggtccgcaccagggcgccgtcagcggccggcagggtcgccggcggggtgtaaaaatcgggaattgttacaccgcgggacgtgccgccggcggcggcatcggcgggcagcggcgtcccggcccagccggctccggtgagtgtcgcagccaatagagctgcggaaatgcgggtacgcagggacatgtccggtcctcctcggcgcgtaaccgcccgttcggtgggtggggcggccgctgttaccggaaggtaactttgtgaactgagacaaaccagatggcagagttctcactccgcctcgccgacggcggcgcgcgctcccgggccggccgggcgccggccggccgattccccctgcttttccgtcggcgcggccccgccctttttcacccgtgaatttctattcggcgcaccgcatcaaacgcgtgcaccgtcacattagcggtcgttaagctcgcatattttgctgttattgctgtcgtgttaattcgctggtcggccagatcaagccattcatgattgccaccgtgtggctcatctcacgccgctgcgccacggctgggcaaactcaaatgtccgattaggagcggttcgctcggatggctcggctgttagtgtcgcgccccgtcgcctgtcacgagccggcgccgcagttctcggccacccacgagacgaagcagaggaacggtcatgaatccttttgaggatgagcacggcacctatctcgtactgatcaacgacgagggccagtattcgttgtggccggaattcgccgacattcccgccggctggacaatcgccaaggccgccgcttcccgtcaggactgcgtcgactacgtcaacgagcactggacggacatgcgtccgaagagtctgatcgaggcgatgggctgacgggtcaccaccgtgccggccgattcccctcccgtcatgacgattcccctgaccgccgcccagcgcggcatctggtacgcccggcagctggcgtccgacagccggatgcacaccatcggcgagtacctggacatcaccggcccgatccggaccgacgtgttcgaagccgccctgcgccgcaccgtcgacgaggcggactgcctgaccgtccgcttcaccgcgacgcccgacggcgaggtgcaccagcagaccggcgcggcggcgccctggcggctcacggtggacgacctcagtgacgaggccgaccccttcgaggccgcgatgcggtggatgcgcaccgatctcgaccggcccttcgagccggaggcgggccgggtgttccggtacgcgctgctgcgcctgtcccccgggcgtcacctgtggtggtccagctaccaccacctggtcctggacggtttcgggatgggcctcatcacccgccgggtggccgaggtctacacggcactgcacgcgggcaccgcggtgcccgcgtgtccgttcgggcgactgtccgatctggtggcccgcgaccgggcctaccaggaatcgccgcggcgcacgcaggaccagcagttctgggccgactacctgcgggactgcccgcagccgcgcggcctggcccacgcgcagccggcaccggccggaccggtgctccgccgctccgggtggatcgacggggcgaccgcccgcctgctgaccgagagggccgaggcctgcgggactcgctggccgctggtggtcgtcgccgcctgggccgcctacctgcaccggatgaccggcgagcgggaggtcgtcgtggggctgcccgcggccgcgcgccgcgatccgcacgaccgggtcacccccgcgatggtgtcgaacctgctgccgctgcgggtgcgggtggattccggggtcggcgtcaccgccctcgtcgagcaggtcgccgcgcaggcccggatcgtgctcgcgcatcagaactaccgggtggaggacctccgccgggaccggtcaccgggcgccgagctgatcgcctcccgggccaacgtcatgagtttcgcgtacggggtgagcttcggcgacgcccgcgcccgcgcgtacaacctggccggtggttttcccgaggacctcgcgatgctggtctgggaccggcgggacggcgaggactaccgggtggacttcgatgccaaccctcggcggtactccgcgccggacgtggtgggccaccgggaccggttcctggccttcctgacccggttcgccaccgcggacccaccggtcgagccggcgcggctcgacctgctgaccgacgccgatcgggcggcgacggcgcgctgggccggcccgggccccgccatcgaggcggccacgctcgccgagctcttcgccgcccaggtcacccgtacgccgcaggcgcccgccctggtgggcgacgacaccacgctgacctacgcgcagttggacgcggtgaccgaccggctcgcccggtcgctgctggcccggggcgtgggtgccgaggacctggtggcgctggcgtttccgcgctcggtgcactgggtgaccgccatgctcgccgtcaccaagaccggcgccgcctacctgccgatcgacccggcgtatcccgccgaccgcatccgctacatgctgaccgacgcgcgccccgtactgctgctgtccagcgcggagaccgcggccaccgtgccgtgcgccggtgtcccggtgatgatcctcgactccgccgaccccgccgaccccgccgcacccccggcgaggccggcaccggcacggccggccggtgccgacaacaccgcatacgtgatctacacgtccggttcgaccggacggcccaagggcgtcgcggtcacccaccgaggtctggccggcctggccgccgcgcagggtgagcggctgtgcgtgcgacccggggaccggatgctgcagttcgcgtcgccgagcttcgacgccgcccagtccgacatctgggtgaccctgctcgccggcgccaccctggtgactccctcggcggaccgcctcaccgtcggacctccgctggcggcgaccgtcgccgagcggggcgtgacacacctgaagctgccaccggccgcgctcgccgtcctgcccggcgacgccctcgacgggatccgcgtgctggcggtcgccggcgaggccctgccggagagcctggtcgcccggtggcacaccggccgccgcatgatcaacgtttacggaccgacggagaacaccgtcaccgcgaccctgagcgggccgctgacccccggcggcccggtgccgatcggcacgccgatcaccggcacccgggcgtacgtcctggacacccggttgcggccggtgccgccgaacgccgtgggcgagctgtatctgaccggggccgggctggcccgcggctacctgcgacgccccgcgctgaccgccggacggttcgtggcctgccccttcggtgcgccgggaacccgcatgtaccgcaccggcgatctggcccgctggacgtcggacggccggctggtgttcgccggccgggccgacgaccaggtgaagctgcgcggcttccggatcgagctcggcgagatcgaggccgtgctgagcgagcacccgggggtccggcaggcggtcgccacggtccgggaggatcgcggtggtgaccggcggctggtcgcctacgtcgtcggcgatgccgcccccgccgacgtgcgcgcgcgggccgccgccacgctgccggcgcacatggtgcccgccgccgtcgtggtcgtcgaccggataccgctgacccccaacggcaagctcgaccggcagtcgctgcccgcaccggactggtccgccgccggcgagccggcccgcacgccgcgcgacgaccgggaggagctgctctgccgactcttcgcgcagctgctgggcgtgccctcggtcgggcccggcgacgacttcttcgcgctgggcggacactcgctgctggccacccggctgctgggccggatccggaccgtgctgcgcgccgaggtgtccctgcgggagctgttcgccgcccccaccccggcccggctcgccgagctggtggccggctcccgccgcggtccgcggccaccgttgcgcccggtgccccggccggaggcaccgccgctgtccgcggcccagcgacgactgtggtttctgcaccggttgcagggccccggtgcgacctacaacatgccgtacgcgctgcggctgaccggcccgctcgacgtcgcggctctacgggccgcgctgaccgacgtggtgggccgccacgagagtctgcgcaccgtgttcgccgcccccgacggcgtcccccaccaggtgatcctgcccgcggaccgggcaacgcccgagatcagccggccggccggtgatcctgggcagtggttgagccgggccgcgcacctcccgttcgacctgtcccgggacctgccgatccgggtccacctgggtgtgctcggccccgacgagcacctgctgctgatggtgctgaaccacgtcgcggccgacggctggtccctggcgccgctcatgcgggacctgtcgaccgcgtacgccgcccggctcggcggcaccggtcccgcgtggcctccgctgcccgtgcagtacaccgactatgcgctgtggcagtcgcgactgctgggcacgatcgacgacccggacagcctgctgagccggcagctcgccttctggcgtaccgccctcgccggtgcgccgcagcatctggagctgccgaccgaccggccctacccggtcgagcggtccggggtcggcggccaggtgccgttcaccgtcccggcgcagctgcaccgggacctgctgcgcctggcccacgaccacgacgcgaccctgttcatggtgctgcacgcggcgttcgccgttctgctgcaccgcgtcggcgccggggacgacatcgtgatcggcaccccggtcgccggccgggccgacgaggagctggacgacctggtcggcttcttcgtcaacaccctggccctgcggaccgacctgtccggcgaccccggcttcggtgcgctgctcgaccgggtccgtgaccacgacctggacgccttcgcccaccaggacctgccgttcgaccggctggtggaggcgctggtccccgaccggtccaccgcccggcagccgctggtgcaggtcatggtgacgctgcaacgtgcggccgacgtcgcgctcagcctgccgggcgtgcacgccgaggcacacccggtgcacctcgacgtcgccaagttcgacctgaccgcgaccatcgtcgagcacgtcggcgccgccggtcagccggccgggctggacggccggctggagtacgccaccgacgtgctcgaccggcggagcgggcaggcgctcgccgagcggctgctgcggttgctgcggcaggtcgccgccgaaccggagcagcggatcggccggctggacgtgctcgacccggccgagcggcagcgcatgctggtcgacgggaacgccaccgccaccgcggtgccggacggcaccctggccgcgctgttcgcggcgcaggtggctcgtaccccggacgcgacggcggtgatcggcgacgacgtcaccctcacgtacgccgcgctcgacgcccgggcgaaccggctggcccggtggctgatcgcggcggggatcgggcccgaggacatcgtggcactgtcgttcccccgcggcgtgcggtgggtgacggcgatcctcgcggtggccaaggccggtgcggcgttcctgccgatcgaccccacctacccggccgcgcggatccgctacatggtcgaggacgcccggccccggatggtgctgacggtgaccgccaccgaaggcggcctgccggctctcgcggcgcccgtcacggcactggacggcgaggagatcgccaccgcgctgccggcgttgccggacacgctgccgccctgcccggccacgccggccaacaccctgtacgtcatctacacctccggctccaccggccggcccaagggcgtggcggtcacccacaccggcatcgccagcctggcggtggccaaggccgcccgcttcggcctcgacggcaccagccgggtcctgcagttcgcgtcgcccagcttcgacgcggccgtctgggagatctgcccggcactgctgtccggtgcggcgctcgtggtgccgtcggccgaccggctcaccgtcggggcgccgttggcggcgacgatcgccgaggccggcgtgacgcacctgaccctgccgccggcggccctcgccgtcctgcccggcgacgcgctggccggggtccggacgctgggggtggcgggcgagtcgccggccgccgaggtcgtgcagcgctggtcccccggccggacgatggtcaacgcgtacgggccgacggagaccacggtatgcgcgacggtcagccgtccgctgacgccgcgggaccggcccgcgccgatcggcgggccgatcaccggcacccgggtgtacgtgctggacgcccggctcgtaccggtgccgcccggggtgcccggcgagctgtacgtggccggtgccgggctggcccgcggttacctgcgccgtcccgcgatgaccgccgagcggttcgtggcgtgcccgtggggcgccgccggtgaacggatgtaccggacgggcgatctggtgaaatggaccggggacggtcaactgctgttcctcggccggaccgacgaccaggtcaagatccgcgggttccgcatcgaactcggggagatcaccggggtggtcgccggccagtccggcgtgcggcaggcgatcgtggtggcccgcgaggaccgccccggcgagaagaccctggcggcctacgtgaccgaggccgccggccggaccctcgatccgcagaccctgcgggacaaactggccgcggagttgcccgggcacatggttccggcggtcgtcgtcctcgacgccatgccgctgaccgccaacggcaagatcgacaaagcggcactgcccgcgccgaacaccgtcgccgcccccggccgggcaccccgggacgcccgcgaggaagtgctgtgtgcgctcttcgccgagctgctgggcgtaccggaggtgggcatcgacgacgacttcttccagctgggcggacactcgctgctggccacccggctgatcagccggatccgcgccgcgctgcgcgccgacctgaccatccgtgatctgttcaccgcgcgcacccccgcccggatcggcgaacgactgaccaccgcccgtcccgcccggccggccctgcgccgcatggcgaagaaagaggacgcctcatgaccaccctctcctatgcccagcaacggctgtggttcctgaaccggctggagggcggcggcgccacctacaacatgccgttcgcgctgcggctgaccggggagctcgacgtcatcgctctcggcgccgcgctgcgcgacgtgatcacccggcacgagagcctgcgcaccgtcttcccggcccccgacggcgtgcccgtccaacgggtgctggacccgggcgcggtggcggtggacctgaccgcgcgggacacctcggacgcgaccctgccacagctgctggccgaggacggccgccgccccttcgacctggccgtcgacccgccgatccggatccgcctgttcgcgaccggcccggacgaacacgtgctgctgctcgtcctgcaccacatcgccggcgacggctggtcggccgggccgctgatgcgcgacctgtccgaggcgtacgcggcgcggcggaccgggcagtcgcccggctgggacgagctcccggtgcagtacaccgactacagcctgtggcagcgggaactgctcggcgaggagcacggcatcctggccgagcagatggactactggcggacgaccctggccgggctgcccgcggagatcacgctgccggtcgaccgccgccatccggcggtaccgtcccaccggggcggccgggtcgccctgaccgtgccggccgagcggcaccgcgacctgctgcggctggccgcgcagaccgacagcaccctgttcatggtggtgcaggccgcggtcgccgccctgttgcaccggctcggcgccggcaccgacatcccgctcggcaccgcggtggccggccgtaccgacgaggcgctggaggatctggtcggcttcttcgtcaacaccctggtgctgcgcaccgacgtcgccggcgacccgaccttccgggagctgctgacccgggtccgggagaccgccctgggtgccttcgcccaccaggacgtgccgttcgacatgctggtggaggatctggcgccggcccggatcccgggccgtaccccgctgttccaggtgatggtgctgctgcagaacaacgccgtcgcccagctcgacctgcccgccctgcgggtccgcaccgagccggtcggcctcggcgtcgccaagttcgacctcaccgtcaatgtcgaggaacagtccgacgcggccggccggcccgccggactgcgcgtgctgctggagtacgccgaggacgtgttcgaccgggcgacggtgcaggcgctggccggccggttggaccggatgacggccgcggtcgccgccggaccggaccggcggatcggccggatcgacctgctcaccgccgccgagcgtgacctggtgctggcgggcgggaacgtcaccggcacgccgctgccggcccgcaccctgcctgcgatgttcgccgtccaggtggcgcgcaccccggacgccaccgcggtgatcggggacgaggtcaccctgacgtacgccgaactcgacgcccgctccgacactctggcccgctggctggtcggccggggggtggggccggaggacatcgtggccctgtccttcccacgctcggtgcactgggtcgtcgcccagctggcggtaaccaaggcgggggcggcgttcctgccgatcgacccggcgtacccggccgaccggatccgctacatgatcgacgacgcccggccggtactgctgtggacggtcaccgagaccgccgccaccctgcccgacctcgacgtgccggtgatccccctcgactcctccggcttcgccgaccagctcacggcatcacccaccgacccgatcacccccgcggcgacaccggcgaacaccgcctacgtcatctacacctccggctccaccggccggcccaagggcgtagtggtaagccatgccggcatcgccggtctcgtgcacgccctgaccgaccggtacggcatcgacgccggcagccgggtcctgcagttcgcgtcgcccagtttcgacgcggcggtcgcggacgtctgcccggcgctgctgtccggcgccgccctggtggtgccgtcggcgcagcgactgaccgtcggcgccgcgctggcggcgacgatcgccgagaccggggtcacccacgtgacgatgccgccggccgcgctggcggtacttcccgaggatgcgctcgccggtgtccacaccctggtggtggcgggcgaggccccgtccgacgaggtggtggaccgctggtcggcccggctccggatgatcaactgttacgggccgacggagaacaccgtcgtggcgaccaacagccggccgctggccccgggccatggtccggcacccatcggcggaccgatcgccggcacccggacgtacgtgctggacgcccggctgcagccggtgccacccggcacggcgggcgaactctacctggcgggtaccgctctggcccgcggttacctgggccggccggacctgaccgcccaacgattcgtcgcctgcccctggggaccacccggcgaacgcatgtaccgcaccggcgacctcgcccaatggaacaccgacggacaactcacctacctcggccgcaccgacgaccaggtcaagatccgcggctaccgcatcgaactcggcgaaatcaccaaagtcgtcaccggacaccccggcgtacaacaggccatcgtcctggcccgcgaagaccgccccggcgacaaacgcctcgtcgcctacgtcacccccacccacggccaccacctacaacccacccagatccgcgcacacgccgccaccgcactacccgaattcatgatccccacagtggtcgtcctcgacacgatgccactcaccaccaaccgcaagatcgacaaggcggcgctgcccgcgcccgaccagctcaccacggacggcggccgcgggccgcgcaccccggccgaacacatcctgtgcggcctgttcgccgagctcctcggggtcgcggcggtcggcgcggacgacgacttcttcgccctcggcggccactcgctgctcgccacccggctcgtgtcccgtgcccgggccgcgctcggcgtggaactgccggtccgtgcggtgttcgccgcgcccacccccgcgcgtctcgcggcggccgccgaggccacggccggcaccgcccgccccgccctgcggccgatggcgctgcccgatccgctgccgctgtccgcggcgcagcggcggctgtggttcctcaaccagctggaggggccgaacgccacctacaacgtgccgtacgcgctgcgcctcaccggtgacgtcgacgccggcgcactgcgcgccgcgctgcacgacgtggtcgtccggcacgagagcctgcggaccgtcttcccggcgaccggcggcgaaccacgccaggtgatcctggacccggccgacgtcaccgtgcggctgaccgagaagcacatcaccgagaccggcctgcggcgggaactcgcgcacgcggcgggcgtgcgcttcgacctctcgcagcaaccgccgctgcgggcctggctctggcatctgggcccggcagagcaggttttcgccctggtcattcatcacatcgccggggacggctggtccaccgcgccgctgctgggcgaccttcgcaccgcgtacgcggcacgcctggccgggaccgaaccgggctgggcgccgctgccggtcagctatgccgactacacgatctggcagcgggacctgctgggcgccgacagcgaccccgacagcctgctcaaccggcagctgcactactggacacaggcgctcgacggcgtacccaccgaactggacctgccgttcgaccggccgcacccggccgtcgcgtcgcaccagggcggccacatccgcctgcacctcgacgcggaggtgcatcgggcactcctgcgcgtcgccaggcagagcgacagcaccctgcacatggtgttgcaggcggccttcgccatcctgctgcaccgcgccggcgccggcgacgacctgccgatcggcgtcgcggtcgccgggcgtaccgacgaggcactcgacgacctggtcggcttcttcgtcaacaccctcgtgctccgcgccgacctcaccgggacacccgatttcaccgaactgctggcccgggtacgggagacggcgctgaacgcctacgcccaccaggacgtgccgttcgaccgggtggtggagaagctggccccggcccggtcggccggccgttccccgctggtccaggtgctgctgacggtgcagcacaccgcgcacgccgacctcggctttcccggcctgagcgggcgagccgaaccggtcgccctcaacgtggccaagttcgacctgctcgccagcttcgtcgaacacggcaccggcaccgagccggaggggctgaccggcgcactggaatacgccgccgacgtcttcgaccggtccaccgcccaggctctcgccgaccggctgaccctgatcctgcggaccgtcgccgccgacccgcgcgcccggctggaccggatcggcgcactgcccgcggacgagcaccagcggatgctcgccgccggcgaccgcagctcgccgccgcccgccggcaccgtgccgcagctgttcgccgcccaggccgcccggacaccggacgccccggccctgtgggccggcggcaccaccatgacgtacgccgagctggacgcccgcgccaaccggctggcgcaccggctgatcgccgccggcaccgggcccgaggtgccggtcgccgtgctgatggaccgctcccccggcctggtggtggcgctgctggcaatcctcaaggccggtggcgcctacgtaccgctgctgcccggataccccgccgaccggctcagctggatcgtcgcccaggccggggcgaccgtcctgctggtcgaccccgacctggccgacacccggttcgagcacggcgccacggtgctcgtgcacgccgacgagcccggacccggccatgccccggacgtccgggtgcacccggacaacctgggctacgtcatgtacacctccggctccaccggccggcccaagggcgtggcggtgcggcaccgcgacatcgtggcactggccgccgatcaccgctgggcgggcggcgcccacgatcgggtgctgtgccggtccccgcatgccttcgacgcctcgacctacgagctgtgggtgccgctgctgcgcggggggaccgtcgtgctggccccgcccggcgaacccgatccgcgcctgctcgcccgcaccatcgccgacggccgggccaccgccgcgttcctcaccaccgccctgttcaacctgatggtggaggagggtgtcgagcacctggccgggctgcgcgaggtcctcaccggaggcgaggccgcgagtccccgggcgatgcgccgtttcctgaagaactgtcccggcaccgtgctgagccacgtgtacgggccgaccgaggcgaccaccttcgccaccgggtacccgatgaccgactccgtggcgctgcccgccgacgacgtgccgatcggcgagccgctggacggcatgcgggcgtacgtcttcgaccggcacctgcaaccggtgccggccggcgtcaccggtgagctctacctggccggagccggcctggcgcgcggctacgccggccgtcccgacctgaccgccgaacgtttcgtggccgacccgaccggacgtaccggcgaacggatgtaccggaccggtgatctggtgcggtggaacaccgacgggcagctggtgttcgtgggccgggccgacggccaggtcaagctgcgcgggttccgcatcgagctcggcgagatcgaggccgtgctcgccgcccaccacgatgtcggccagacggtcgtcgtggtgcgcgaggaccggcccggcgaccgtcggctggtcggctacgtcaccccgggacgcgccggccggccggtcagcgccaccgaggtccgcgcctacgccgtcgcccacctgccggagttcatggtgccggcggtcgtggtcccgctggacgcgctgccgctgaccaccaacggcaaggtggaccgcgccgctctgccggtgccggacccggccgcgtccggcaccggccgggctccgcgcgacgagaccgaggcgatcctctgcgggttgttcgccgatctgctgggcgtcccgacggccggcatcgacgacgacttcttcagcctcggcgggcactcgctgctggcggtgcggctgaccgcgcgggtccgcaccgcgctcggcgccgaactctagctagctaggccgctggtcgcctcggtgcggcccgcacggccgccgctggcggccgcccaacgacggttgtggttcctgcaccaggtggaggggccgagcgccacctacaacatgccggtggtgctgcgcctggacggtgtgctggaccccgcggcactgcgggcggccctggacgatctgacggcgcggcacgagacgctgcgcaccgtgttcgccgacgacggcggcgtggcgtaccagcgggtcctcgatccggcgcagggcaggatgccgatgacgacgctgcgcgtcgcggcgtccggcctgccggcggcactggccgacgccaccggccaccgcttcgatctggccaccgaggttcccgcccgggcctggctgttcgaggtggggccccgcgagcacgtgctcgccgtggtgctgcaccacatcgccggtgacggctggtcgacggccccgctgctgcgcgatctcggccaggcctacaccgcccgcgcgctcgggcggacaccggaccgcggcgccctgccggtgcagtacgtcgactacacgctctggcaggaggcgctgctcggcacccgggacgacccgggcagcctgatcagcggccagaccgaatactggcgcacggctctcgccggtgcccccgacgagctggcgctgcccaccgaccggccgcgtccggcggtgccctcgcaccggggcgggcacgtgccgttcaccctggacgaccggctccatcgggcgatggccgagctggcccggcaccacgacgcgaccttgcacatggtgttgcacgccgccttcgccgtgttgctgcatcggctcggggcgggcgacgacctcccgatcggtgcaccggtcgccggccgcgccgacgaggcgctcgacgatctggtcgggttcttcgtcaacaccgtggtcctgcgcaccgacctgtccggcgaccccaccttcgccgacctgctgggccgggtccgggaaaccgccctggacgcctacaccaacgccgacgtgcccttcgaccacctggtggagcggctggccccgaaccggtcactggcccggcagccgctgttccaggtgatgtgcgtgctgcagaacaacgcgaccggcgaccccgatttcggcggcctgcgggtccgccgggaagcgggcggcccgccggtcgcgaaattcgacctgaccgccacgttcgccgagcggaccggcgagcagggcggacccgacggcatcaccggcgtgctggagtacgccgccgacctgttcgacccggggaccgccgcggcgctggccgaccggctggtcaccgtgatcgagacggtcgtcgccgaaccggagcgccggatcggccgggtgcaggtgctcaccggggccgagcgggaacgggtgctggtgacctggaacgaccgccaggcaccggtacgcccgggcaccatcggggagctgttcgccgcccaggtggcacgcaccccggacgccaccgcggtgatcggggacgaggtcaccctgacgtacgccgaactcgacgcccgctccgacaccctggcccgctggctggtcggccggggagtggggccggaggacatcgtggccctctccttcccacgctcggtgcactgggtcgtcgccatgctggccgtcaccaaatccggcgcggcgttcctgccgatcgacccggcgtacccggccgaccggatccgctacatgatcgacgacgcccggccggtactgctgtggacggtcaccgagaccgccgccaccctgcccgacctcgacgtgccggtgatccccctcgactcccccggcttcgccgaccagctcacggcatcacccaccgacccgatcacccccgcggcgacaccggcgaacaccgcctacgtcatctacacctccggctccaccggccggcccaagggcgtcgtcgtcagccatgccggcatcgccagcctggcggcgaccaccggcgatctctaccgcaccggcccggacagccgggtcctgcagttcgtctcgcccagcttcgacgcgttcatccacgacgtctgcccgaccctgttctgcggcgcggcgctggtgatgccgtccgccgaacggctcacggtgggcggcccgctggccaccacgatcgccgagaccggcgtcacccaggtgaccctgccaccggctgccatcgccacgctgccggccgaggcgctggacggggtcgaggcgctggtgaccgccggggagacggcgagcgccgaggtggtggaccgctggtcgaccgggcggcggctgtacaacgcgtacggcccgaccgagaccacggtgtgtgcggcgatcagcacgccgctccgcgccggggtgtggccgccgccgatcggcgcaccggtcctcaacagccgtgcgtacgtgctggacgcccggctgcagccggtggcacccggcgcgaccggcgagctgtacgtggccggaaccggggtggcccgcggttacctgggccggcccgacctgaccgcccaacgattcgtcgcctgcccctggggaccccccggcgaacgcatgtaccgcaccggcgacctcgcccgatggaacaccgacggacaactcacctacctcggccgcaccgacgaccaggtcaagatccgcggctaccgcatcgaactcggcgaaatcaccaaagtcgtcaccggacaccccggcgtacaacaggccatcgtcctggcccgcgaagaccgccccggcgacaaacgcctcgtcgcctacgtcacccccacccacggccaccacctacaacccacccagatccgagcacacgccgccaccgcactacccgaattcatgatccccacagtggtcgtcctggacacgatgccggtcaccagcaacggcaagatcgacaaggcggcgctgcccgcgccgaacctggacgtacgccccggccgggccgcccgcgacgcccgcgaggagaccctgtgccggctgttcgccgaggccctcggcgtccccgaggtcggcatcgacgacgacttcttcgccctgggcgggcactccctgctggcgacccgcctcaccgcacggatccgggacaccatcaccgagcacgtgtcggtccgcgacgtcttccagagccgcacggtcgcggcgctggccgagacactcgccggcgtcacccgctcggcgggggcggccctgaccgccgacgcccgcctcgatccggcgatcgtcgtcggcggcccgcaccgccgggcggaaccggggcggatcctgctcaccggcgccaccgggttcctgggcgcgttcctgctggccgagctgctccgggcccatccggacgcccggatcgactgcctcgtgcgggccggcgacgaggtcgcggccatgcaccggatcgagcacagcctgcgacgctacctgctgtgggacgacgcggaccggacccggatctgcgccgtccccggcgacctggaacaaccacggctcgggttgagccgggaccggttcgacgagctggccgcgtcggtggacgtcgtgtaccacaacggcgcccgcgtgcacctggccgacccgtaccagcggatgcgggccgccaacgtggacgcgaccaccgacgtcatccgcctggccgcccgccgtggcatcccgctgcactacgtgtccacgaccagcgtgctgtactccaccaccgacaccccgccgctgctcaccgaggaccggcacgtacccgccgaccaggtgccggccaacggctacatccagacgaagtgggtggccgaggagctcgtccgcgaggccggccggcgtggcctgcccgtggcgatctaccggcccagccggatcagcggtgcgaccgcgaccggggcgaccggcgacggcgacgccttctggaacatggttcgcgcctgcgtcgagatcggcgccgcacccgaccggggacggctcgccgacgtcgacctcgtgccggtggactacgtggcggccgccctggtgcggctctcgcacaccgtcgacctggacgggacggcgtatcacctggtcaacccggtgcacacccgaccggcggacgtgttcgcggcggtccgggccgccggctacccgatccgcggcctgtccggcgccgagtgggtcgccgctctgaccgacgcggcccgcacggcggctccgggcagctcgatcccgggtgtggcgctgttgcacggcggcacctccggcgagtcgctcggcaccgagccccgattcgacgacagcaacacccctcggggcctcaccggctccggcatccagtgccccatcgtcggccccgacacgctgcggcgctgcgtgcgcttcttcgcgtcgaccggcttcctgcccgaggagcgttcatgagtcagccgttggtcctgcgcaaccgggccttcgcccgggtgtgggcggcacagatctgcagccaggtcgccggccggatgttccaggcgggcatcgtctggtgggtggtgagcgaggtggccgcatcggtccgcggccgggccaccgggccgttcatgatgctggcgtcgctgcccgccgtgctgctcatcccggtggtggcccgggccctggcccgctacaccagccggagcgtgatgcgcacggccgagctcgccgccgcggccgtcacgctcgtgctgctcgggtgggcgctgctgaccgacctgccgatggcggcgccctacccggcggtgttcctgctggccgtcacccagtgcttcttcaacccctgcctgaccaagtcggtgcccgagctggtcgacgccggcgacatccagcacgccacgtccttcgagatgtccacccagtccatcgccggcctggtcggggcggtggccggaccgtacctgatccacctcggcggaccggcccccctggtggcggcctgctccggagcgttcctgctcgcggcgctgctgatccacgtcgccggtttccggaccggcacggcacctcggccatcggcaccgggcggccccgcacccgccccgcgcaagctgcgtgccgtgctggctgatctgccgttcgtccgtaccgtgctgatctgcttcgccgcggcgaacctgttcgccacggccggggcggtgatctatccgctgtacgtccgcggcgtgttcggcgacgaccccggcgtgctggtgctgttccaggtggccatcggcatcggcatgctggtcggctcgttctccggaccgcacgtccccggccggccgacgaccctcggcccgctgtgcctgctcgggatcgcggccggcctgaccgtgcccggcctcgtcgtcaaccggatgctgacctcggtggcgttgctgggggtcggctggtgtgccggggtgctcggcgtcaagttcgtcaccctgttccagcacaccgtgccggcggcggacaagccggtcttcttcgccgccatgcaggcgctgatgaccgcgacgttcccggtggcgtcgatcgccttcggattcctcggcgacctcctcgaaccgcgcacgctctgcctcgtccagggcatcgggctgctccccgcggctctcgccctgctgacgacgcgcgaccgggagccggtgccggtgagctgagcgccggacccgaccggccggcatccgccggccggtcgggtccggcgtccgcgacgacggcgcctagattccgcggcggcgccaggattgccaccagagccactcctgggccttggcgcccaccgcggagagcaccaggggctgcaggtacggcatcgtcttggcgccgacccggcggcgcagggccagcgcgcggtattcgggaagtctgcggtagtcgggccagacctcggcggcgaaggcgaccagttcgtcctccggggtctgcgcggtgcggccccggtcgtaggcgcggaaggcccggcgcagggcgaagcgggccagccgggcgtggaccatggcgtccagctcgtcccgctggggcagcaggtcaccgcatttgcgaaggaccgactcgtaagcgatcttgcgctcccgcaggtcgtcgatcgcgcccgcgtcggcgtgcatgttcttcgcgtgcaggcggtagtaggcctggtccgccttgacgtagccgacgtcggcgtgcgacgcgaggcgcatccacatctcgatgtcggcggcgtgcgggagctgggggtcgtagccgccgaccttgcgctgcaggtcggtgcggaccaccacctcgggtgaggtgatgcagccggtgccttcgcggaatcggcgttccagccaccagtggccggggtagacgacggtgccgccggtgccccggttggccggcgggggcgggccggggtgctggaagtggaccgggtggccgtaggcgaagccgacgttcgggttcgcgtccagcagcgcgacggcacggttcagggcgcccggggtgagcatgtcgtcggccgagagcagcgtgacgtagtcgccgtcggcccagtcgagcaggccctcgttgtaggtggcgatgtgtcgcttgttctcggtgtgtacccggacctggacgcgcgggtcggccgcggcgatcgcgtgggccttcgatgccgagtcgtccggggacgcgtcatcgatgatcagcacccggatgtcgaggcccgggttgtcgagcacgctgtcgacgcatgcccgcaggtaatcgccgtacttgtagcacgggatcacgacgctgaccgaactcaacttctcccccagaggtcaaagaaaggggcccggcaccgcacggtgccgggcccggagaatcactgcgcggtggtgctgaagatcgcgtcgacccagtagttgttcgcgttccacgtcgaggtcgggaacgccgtaccggcgctctggatgaacagcccgttgtgcccggtggccgcgtcggcgaccccggtcagcgggtacgacgtgtggtcggcgctgaagaacccgctgctgtacgagtagaacccgaccgtggtgtggtacgagaccacgtacggcgtcccggcgtcgatcgcgaccggggtggcgaacttcagcgtctgccacccgctgccgctctcggtggtgaacgtgccggtggccagctgctgcccggtggcactccacagcgtcccggtgtgcgtgccggtgttccggtcgcccttgtagaacttgacgccggtcacgtagccgtcgatcgccgaggtgaaccgcatgccgagttccagtgaggcggcctcgccggcgctctccacgtcgggcgtggacgacgggctgaacacggtgcacgggcaggacaccccggtgccggtggtgaacgaccaggtggtcgccccggtcatcgcgttgccccacagatcggtggccttcaccgacgcggtgaacgcggtgctcgcggcgagcgcgctgtccggctgcagggtggccctgcgggtggtgtcgtcgtaggccaccttggccggcacgttcaccccgcccgcggtgagcgtgaacgcgatggtcgccgggtcgatgtcgtggtcgaaggtcgcggtgaccacggcgttgcgggccacgcccacgtcaccgtcggccggcgacttgaccgtcaccttcggcggggtggtggtcgccgcgctggtctccaccacggcgtccacccagtagttggtgtcgccccagctgaggttcgggaagccgccgtcggtgccgtatctgtagaccccgttggccccggccaccccggactgcagctgcttgacgatgccgtcaccggcgcccttggtgctgaagtatccgctggtgtacgagtagtgcccggtcggcgtgtagtacgacaccacgtacgtggtgttcgccgcgatcgacaccgacttgctgaacgtcagggtctgccagccactggcggtctccccggtgaacgtcccggacgcgagcagcttgccggccagcgtgtacagcttgccgacgtgcgtgccggtgttggtgctcgccttgtagaacttcaccccggtgaccgaggcgggcaccgcgacctggaacttggcgcccagttcgttggccgagccgtcgaacgagtcgacgttggccgggacggtgctcggcgtgtaggtggtgcacgggcactgctgcggcccgacggtcacgttgaccgtcctggtggtgccgaagttcaggctgtcgtcgatgccgcgcaccttgatcgtggcggcaccctcggtgaccggcgtccaggtgtacgtccagttcgccagcccgacggtggcgttccaggtggtgccgccgtcggtggagacctcgacccggccgagctggccgccggtgtcggccgcggtgccggtgatggtgatcggcgacagcttcggcaccgtggtgccgcccaccggggcggtgacggtgaccgccggaccgaccgtgtcggaggtcttgctcgggtagaccaggttcgtctggaacgacttcgggaaggcgttcatgtcggccagcacgttcgcggtggcctgctgcatccggatgtcctcgacggtggccgggccggtgtgctgggtgctcaggccccacgaccactgcaccgtgccggcgccgaagaccagcgcgccggaggtggcgtcgcggtacatcacgacactgtgcgtggcgacgccgttgccgtagttgttgccctcgtcgagcagcatggtgccgtcggtgatctgcagcgtggtggccgagaaccggatcgcgcccggtggccggaccgcattgtcgacgtcggagtcccactcgtagccgagcgtgccgaccgggaaggtcaccttctcgccgtcgttcagggtcgggatcctggtgtcccgccagagtcgcaacttcttgaagtcggaggtgaccgtcatcgcgtcgttgcggtagccgttgacagagaacagcgtgccggtgatctggttctgcggcgcgttgccgccggtgccggcaccggacgggtccatccaggtgccggtccactgcccactggggtcgggaacgccgttgaccggggtctgcttcgtcttggtcgtcttgtagctgaccagggtgcggtggtcaccgccgccggcgctgatcgacggctcccagcgggtccgccagaacgcctcgttgccgctgaagaaggccaggttcacgccggccgcgcgggccgccttgacgttgttccagatgccctggtcccagtactcgtcgtggccggacgacaggtagaccttgtgcttgggcagcagcgccggcttggtggagacgtcgaggttggaggcgtagctgacgtcgtagccgttgcgctccagccaggagatcatcgggtactcgctggccagcacgccgttgtcgccggcgatccgcatcggccggttgtagctgaccttgtaggcgcggccgtccggggcgggcccgccgccctcgtagaggttctggccgccgaacttgttgtaggcctgccaggtctcgtcggaggtctgcaccacgatgtcggagtggctgttgtcgttggcgacgacgaacgggtacggcatgtagccgttgccgtcaccctggtcgaagaccgccaggtagacgccggagaccgcgtcggagggcaccgcccaggtggcgttgaccgtccacttcccgcagtcgaccaggccggtcgcgtcgctgtcgcagccgccctgattcttcagcgggaacgtggtggtcggcgaggtcggcatccggcgggcgccgtcgcccttgtagtagcccagccggtagatggtcaccgtgaacgtcgagtccggcgagttcaccttcatctgcagggtctcaccgggctgcacgctcaccttggtggtgaagccgccgatgtcgccccaggaggcgtcgccgtaccagtcctcgagcggggtgcccggcttggagttctcgcagacgatcgggttggagttgaccccgcacgggtcgtcggccgcgagcaccgcagccggtggcaggacgacggcaccggcgaccagcgccgacaacgctcctgagacgagcctttttatcacttcgagcttcttccggcctaaggagatcatttgggttgtggaacctgtttcttcgtgggcaccccgtcgatcgttcccaccacgttgttcgaccactcgccgaaggtcaccgagcagttcttgtcgcatccgcccgcggcatcccagtgcgtggggccgaagacgttgtccgtgatcctgatgtccgcgccggtctgcgcgtagagcccgtaggccccgagcgagatgaagctgttgcggaccgtgtagttgcgcagcaccgatccgtcgacgctctgggtgaacaggacggcggtgatcgccttccagtagttcttcacctctttgccggtgtgcgcgtcgatccccggctccagccggctgttctcgatggtgaccgggccggtgccgccgtacgggaacactcccccggtgtgcgcctgtcccggatcggtgaggttggcgatgtagttgtcgtgcagccagctgttccggatggtggtgcgggcgccgcagagacacatccccccggtgttcgcgacgtcgacccggttcagcgtgatcgtgcaggtgacacagtcgttgatggcgtgatcgttgagcggggtgctcttctcaccgagtccgaccggttccgggcggatggtgacgttcgtgaggttgaggtgcagctggccggagccgtcggcgttgaccaggaccgcgcggttctgcgagccgggcggcggggcgatgatcgtgttggtgatgttcaccgtgccgtggcagctggtcccgacgtagatgaagcccttgatgtacttgtggtcgatgttgaccgtgttcttgcagtcgtacaggtcccactctttgctctcggcgttgctggcctgcagcaccttgtagccggccggaacgggcagggacgcgtcggactgccggtagggcttcaccccgggcgccccgacggagaaccgcgccgggtaccggccgccgccggtcgcggtcaccggcaggggtttcgccgactgcgacggtacgccggtgggctccttggccggtcccgacgcggacgccgagggatccacaccggtcgccccgggcggcggggtgatgccggcgaccgccccggtggtggcgcccgcctcggcagggctccttgcgccggtgtcgcgcagcacggcgaagaccacggcggccgcgcccagcaggacggcgagcgcgccggcgagcagcaacctacggcgtcggggtgtcacggcaactcccacggggtccagtagctgtccgggttgatggtgtagttcacggtcggctccgggatgtgctcgacacggtgccggcggctgaaccggtagaccagctcccagtcctccttcggcgcgaccgaggtggtgcggcgcagccggctgaagcgggtggcgggcaggcgccgcagcacgagcgggttgttgtccaggtagcaccgctcccaggcgagccgccggtcgaacgggacggacagcacgtcgcgcaccgtcccgtcgggcatgatccgccgcatggcggtgtagaccgcgtccgggcggttcggcgccgccggcccgtccagccgcgcgagggccgtctccaggtggtgctcgtcccaggtgttgtcgtcatcgaggaaggcgacgtggtcggaatcggtcagcccgataccgacgttgcgacccaccccgggcacgttgatgttgtgccgcagcgcgacggtgtgcagccgcgggtcgggcgggagatccggcacctgcccgccggcgtcgtcgaccacgatcaggaccaggtccttcatggtctgggcgaggaccgactcgacggcgcgggccaggccgtcggcgcgctggtaggtgagcacgatgacggcgacccgggcccgcggccggaccccgccgggcagggtcggcagcaggcgacggacctcggcgcgctcgaagcgggccaggccgaccgcggtgtgcccgagcacgaccttgttgcgcagctcttcgagcggcaaccagccgtaccggtcgcgcagccgcttcttcagcgagggcatgtcggcggtctcctagacggggtcggcgacgggatcggcggccgggacgacgggatcgggctcggccggcgacgagggcgcggaaggggacgacggctcggcccgcaggcggttgatgagcgggaggacgaacgggaggtacgtggcgagcgaggcgaccccggccaccgccaggccgaggaagccgccgcccagccagcggtgcgcgagccaggccaccacccccatcgccaggccgcccagggcgggccgcacgcaggcgatcaggacccggccggccgggatgccgagccggccgagcaccaccacgaagaccgggctgaccagcaggccggcgaccaccacgtggccggccgcgacgccgcgcacgccccacaggtgcgcgccgatcagcagcagcgggatcagcgagaacagccaccaggcctgcatcaccatcagggtcttgcgcacccgggtggccaggcagtcgtaggccagctcgaccgcggtgcgcagcagcccgagcgcgaccaggaactgcaggggcagggcggcggccgcccactggtcgccgtagacgaacgtgatgatcggcccggcgagcacgccgaggaccacgcagatcggcaccgcggccgcgatcaccagggtgaaggcgcggacgaagccggtcgcgaactcgtccggcgagctgtcggccaatcgggagaagccggcgaacgacacccggcgggcggtctccgacaccatccggaccggccagctggacatgttgaacgccatcgcgtagatgccgagcgcggcggggccgagcaccgagccgaccaccaccgagtcgacgttgacgatgcccagggtgagcaggctcgcggcggccagcgggaacccgtaccgcagcagtcgtttggcctgttcggtgttccagccgaagcggagcatgcccggggcgcagaggccgaagccggccagggcgaccaggttgccgatcagcgagccccaggcgaagctcatcgcgccgacgccggccgccgcgaaggcgatcgtggcgaccgtgttgaccacgaagttgaggatgtcgacgacggtgcggccgaactggcggaactcgcggttgagctgacccagcgggacgcacgcgataccgtcgatgatcacgctgacgcagagcacgcggagcatcgtggtggcgtccggcgagccgagcgcgcgggccagggccggtgcggcgaaccacaacaccacgtagaaggcggaactggacaatgtggacagtgtgagcacggtgggagcgaagcggcggatgtcgccctcccaccggacgagcgccaggctcacacccatctcgttgagcgacagcagcatcgccagcacgagcaggccgaccgcgtacagaccccactcgtagggtccgaagtagaggcgcgccagcaccacaccggaggcgaacgtgccgacccggcggacgatggtgttgaccagactccagcgggcggcggtggccacccggccgttcagatccgtcactgtggagagtctccttcgcggcgggccacgctcaggtacgcaccggacaggcccaacatcaggaaagtggatccggccacgatcgggaagctcagggtgtcgaaagtgaccgttacgacgagcatcacgaacccgacggccacaaacgcctgaccggtctcccggcgtgccgggtcggtgaaacggcggcgaccggcgccgccacaatggatggtcgccacgtagagcccgacgatcgccagcaggccgaccacgccgatctccagcagggccagcaggtactgattgtcggtgaagcggtacaggtcgggcaggaaggtgccggggccgcgcccgaaccaggtgtgccccttcatgaactcgcccacgtcggcgctggtcgcggtccgcgagttggtgctgttgtcgccaccgttgaacatcgcgctgaacaggccgatcagcgtgccgaccagacccgggacgaggatccgggtggcgcccagggccgggatcatcagcagcagcgccttgccgacccggccggccggccaggtgaccaccagcaccaggaagaccagcaccaggccgatcaccgaggtgcgcgacacggtcatcaccgaggccagcgcgatcacgaagaccggcgcccagcgtttccacggcttgcggccgtcggtgtcgtacagcgcctgctggatcgcgaacggcagggcgatgcacagggtggcggccagctccagggtgttcgacgcggtggccgtgggccgcacgaagtcaccgcgggcgaccaactcggaggcggcgttggaggacaggccggggatcacgatccaggcggtcaggctctgcttgagcacgaactcggccatcgccagcaccgcgacccaggtgcacagccggacgaacagcttgagcagccgctcgatctgccggtactcggtgagcgaggtggtcagcaggatcagcgggagccagatcagcagctgcagcagggcccggtcggcggcgctgtactcggcggcgtcggcgtcgcggcggccgaccgccacgtacgccagcaggatcgcgacgacgtagaagagcagtgcgagccggggcacccgggtgaacggcgccggggtgacccggcgcatcaaccagctgatcgcgtaccacagcagcgagaccagcaggaacaggttggcgaccgtgccggtagcgccgatgctggccaccaccagccgggccgggacgaccagcagcaggacgatgtaggtggcgagcagggaatccgggccgagggtgcgcaggcgctgctgggagcggtacaggcgacccgggcggcggtcggtgacggtggccgcgtgcggctcgcgcgtggtgcggcgagcctcagctgccgttgacccggttggcatctttacccctacggtccacggcgttgccgttcgactggtacgtcgtggcgagcccgccgccctgccgcggcggcggcacctggatgcgctgggtcttctccacgtccaccgaggccgcggcggaggagccggcgacgcccatccggggctcgttcttcggcgggagctgcagcaccacggtgccctcgatgtccggggaggcgaccgcggaaccggcggccggcctggcggtgctgaccgggggctcggccgcctcgctcgcggccagcgcggccttgcggcgccgggcccggctgatgctctccaccgcgaaggccgcgacgaacccgagtgccgcggtgccgccgccggcgacgatcaccagcttgagcttcgccttcgtctccacctgaggcttctgcggcgggatgacctgggtcagcttgatccggtccttctccgcgacgttgttctgctgctggatctcggtgagcgtcttgtcggcgtactgggcgagccgggtcgccgaggcgagcaggtgctcctggtcgtcgccggtcagggtgatggtgaggaacgggccctgggcgttctcggcgagggccaccacgtacttctcggtgattccgtcggccctgagctccagctgcgtgtcggtggactgcagccggcggccgaggaagtcggcggtggccacgagcgagccgttgaagttcaggaacgggttgtcctggccctcggtggccgccttggtcgccgccggggcgctgagcaggctgaccatggtgtaggtggagtaggtggtcggcaccatgaggtacgtggtgatgcccagacccaccgccagcaccagcatgggcacgacgatgagccagcggttgcgcaggacgcgcaagatctcgccgaggtccacggacgcctctcccaattcccgccaggacgtctttcgtcgccacggagttcctcatcggaactccgccaaggcggcccccgacgcacgccgccaagctatacgacgaatgctacggaagctattggacatccgatccacatcgaagttgacgagctccggtcgggcaggctaaggagagctgcagcaggccggcaccagggaaacgggtgaatcatgtttctgtccgacatggcgggtgtactgaaacgccgctggtatctgatcatcgtgggcgcggtgctcaccgccgccgtggccagtccggccgtgcacacccgggaccggttcctcgcctccgaggtgctgatgatccagccgccggtgtcgccgtacgcgccgaacccggtgaccggtctgtacccgtcgatcgcggtgaccgcggcggccatcgcgaaccggctgaacacccccgactcgcaggccatgttccgggccaagggggtcaccgggacgtaccggttcgagccgcgcaacaccggcacccggcaggagccgcggtatgtgatcggctcgatgtcgatcaccaacaccagctcggccgaggccgacgcgctcgcctcgctgcaggtcctgagcagcacgtacgagcaggagttgaaggctatgcaggacgagtggaacgtcaagcgcgacctgcggatcaccgtggccaccctggtcccgccgacctcgacgctgctcacccactcgccgctgcgctcgctggtcggcgtcgcgctgctcggcgcgctgctgaccgccgctgtcacattgtggacagatgagctgctgcgccgacgccggtcggcacggttgtccacggcagactccccgaattggactgatccactggtccgttcagcccattagccacgcgagcgcgtttctgaaatgttgttcgcgtcagtaggctgctgagcgcggggtgtgattcgtggggaaaagaccgagcgtcgcgattctggtggcgaacctgccggccgagaaggatcgccgcgtgatccgggaatgcctgagtctcgaggcggccggatacgacgtgacggtgatcgcaccgcgcggtgaccgcagcctcacgatcctcccgggcagcgagcggacccgactccggccgtacccgatcgtcgtctacggcagcggggtgctctcgttcgccgtcgagttcttctggtcgttcctctggatcagcatccggctgctcggcgagatcctgcgcggccgggcccaggcggtccaggtgtgcaacccgccggacatctacttcccgctcgcgctgctggtccgggcgctcggccggccctgggtcttcgaccaccacgacctctcccccgaggtctacgtctcgcgcggcggcgagccgaacccgctcgtctcccggctgctggtcgccttcgagtgggcgacgctgcgcaccgccaccgcggtcttcgcgaccaacgagtcgttcaaggacaacgcggtgcgccgcggagtgagaccggagaaggtcaccgtggtccgcaacggcccggcgttcgccgagatcgcctcctcggacggccccgccgacggtccgcaccgcgtcgtctacctgggcgtcttcggcccgcaggacaacgtcgagggcgccgtgctggccgccgaggagctgatcgggctgcgcggccgcaccggctggaagatgatcctggccggggacggcgagaccgccgccggcctgcgcgagctcaccgcgcagcgcggcctgggcgacgtggtggagttcaccggctggctgggcggacccgaggtcgacgcgctgctgcgcgaggccaccgtggcgatccagcccgacctgccgacccggatgaaccagctgtcgaccatggccaagaccgtggaatatctggggcgcggcgtgccggtggtggccgccgacctgatcgagacgcacgcgaccgtcggcgacgccgggctctacgtgccgaacggcacgccggaagagttcgcggccgcgatcgacaccctgctcgacgaccctgacctgcgggccggcatgcgcaagctcggccgcgagcggttccgcgactccctgtcctgggagcaccaggcggtgcagtacatcgcggtgtgggaccggctgctgcgccgtggcggcacaccgcggatcccggcgcagcggcagccgtcctcggcgccgtcccgggtggacgcgccgtgaccagtgtggtgatcgccgcgcacaacgaggcggcggtgctcgggcggtgcctggacaccctgctcgccgacgcgcggcccggcgagttcgacgtcaccgtggtggccaacgggtgcaccgacgacaccgcggcggtcgcgcgatcccgtggcgtccgcgtcatcgaactcccggagccgggcaaacccggcgccctgaacgcggccgacgaggtcgcggccggttttccacgggtctatctggacgcggacatcatgctgaccaccagcggtctgcgggacctcgcggcggcgtgtgcctcgacgccggcggcgaccgcccgacgggaactcgatctctccgggcggccgctgccggtccgggcgtacttcagcgtgcaccggcatctacccgccctgcgaaccggactgttcggccgcggtgtgatcgcgttgtccgggtccggtcgggcccggttcaccagatttccggacatggtggcggacgacctgttcgtcgactcactcttcaccaccgacgagaaacaacaggtggcatcggtcgcgtcggtggtcgcgacgccgcgccacacccgcgacctgatccgccggctgatccgggtccgggccggcaacgcggccatgcgggccgcggcggcccgcggtgagatccaggcggcggtacgcccgtccgggcgctcgtcctggctcaaggacgtggtgctgcgccgcccctggctggcccccgccgcggtctgctacgtcgccatcaccgtgtacgcagccgtgcaggccagacgtcgcccagataccgagtggggccgggacgcgtcaaccagggagtcggcgagtgcctgagcagttcaacatcctgttccacgggatcgggaccccgcggcgcgacctggagcccggcgaggaccagtactggatcaccgaagacgcgttccacgcgatcctcgacgaggtcgccgcgtggcccgcggtcagcctcagcttcgacgacagcaactcctcggatatcgagatcgccctgcccgccctgctcgaccggggcctgaccgccgagttcttcgttctcgccggccggctcgaccagcccggcagtctcggcgaggccgacctgcgtgacctgctcaaacaggggatggcggtcggcacgcacgggatgcaccaccacccgtggcggggcctgaccgcggacaccacgcggtccgagctcgccgacgcccgggaccggatctccgcggtgatcgggcggccggtcacccgcgccgcgtgcccgctcggccggtacgaccgcggcaccctcggcgcgctgcgccggctcggctacaccaccgtcttcaccagcgaccggcgcccggcgcggcccggccgctggttgcagccgcggttcagcgtctatcgggacgacaccccgtcgacggtacgtgcggccacccaagggtcgcgccggctcccggtgcggctgcgcaacgcggcggccggcgtggtcaaacgctggcgctgaggcgcgttgtaggcgaccaccccaccgacgatcagcagcagcgccacggcggcaccggcggtcaggccctccccgaagatcggcacggccagcagggtggtcagcaccggactgagcgcgccggtcaccgccgggatcgaactgcccagccggcggacggcgtacgcgtagctgagcgtcgacacgattccggtgcccaccccctgcagcaccacgaacagcacgatggtcccggccggggcggctttcaggtgcgccgacccggccagcgcgatcagggccgacggtgtgcagacgaccagcaccaggctgatcagatccagtccggtgcggctcagcgccatcgtgtagaccgcccacgccagcccggcggccagcagcaccgcgatcccggccaggccggcgtgcgcgacggtcagcacggccaccccgagcaggatcgcggccagcgccggccaccggcggcggtcccgcttgagcagtgccacgaacagcggcaccgtgccgggcagcagcaggcccaccacggcggccgaggccagccgcccgcccagcgcggagagcagatagtgcggcagcccggccagcaggagggcggcgatcgtcgtcggccgctcccggcggaccgcccggacggcgcgcggcagccacggcgacagcaggacgaccggggtgccgaaccgcagcaacgcggcgtccatcgcggtcagcccggacccgccgatgccccggacggtgagcgcgaacgacgcccagagcaggacggcggcgccgagcgccagcatgccacggtgttgtcgctggaccatgcggccagactaggaattcttcaggcgcagccgattgctagttctgccctcaaccggcctcccggtggcagaatctgctacgtggactcgatcgatcgccggattctgctggaactgcagaaggacggccgcctcaccaaccaggaactcgccgaccgggtcggcctgtccccctccccctgcctgcgccgggtccgccagttgcaggactccggcgtgatctccggctacaccgcggtgctgtccgcggaggcgctcggcctgacgatcaccgctttcgcccggctcaccctgctctcgcacacctcgacggtggtcgacgaggtggaggcgcggctgcgcgccatccccgaggtggtcgaggcctacctgctggccggcgacgacgactacatggtgaagatcgtggtggcctcgttcgccgcctacgaggatctgctgcgccgcgagctgcgcgccatcccgtcgctgggctcgatcacgaccagcttcgccttcgccgtgaccaagccgcagtccccgctcccgatgccctgagcgggccccgggtggggctcagaggtggccggagatgcgggggtcgtcctcgcgcatctcgtggaccttgccgttgcggtcgatgacccggacgacccggaccatgcgggccttcagcgcgcgaacagccaggaacgccgcgccggccagcgccgccgtggggacgatggtgcccggagacagcaggtcggcgagagtcatgggacccagtctaccgcccgtccggacaccggccagtgccgcgagatccgccggtcagctcgcccggacccgggcgacgctggccgggccgggggtctcccggaggcgggacggggtgagcaggtcgcgggtggcggcgcggctcggtttccggcccagggcggcgcgactgctttcgcgcagcagcagggcggcccagtacgccgccgtccgcaccggcccgtgccgccggccgaacagccgcacccggttgagggtgagcagcgcccacagacccggggagacccgcgagtcgccctccaggtgcacggcgtgcgcgtccggcacgtagcgggtgcgcaggccgagatcccgggcgcgcagcgcgaagtcggtctcctccgagtagaggaagtacgactcgtcccacggtgccacccgcgaccagcattccgcgctgatcagctgggtcgagccctcggcccagtcggtcacgccctgcgacacgtacgcccgctcgtcggtgatcacctcacccagcaaccggaagcggcccgcccgccgtgccccgaggacggcgtccccgagcgtgcgcagcacgctgggctcccggcgcagggtgtggatcagcgcgccggagccgtcgacaaggtgcggcacggcgatcccggtaccgggcacgcgcagcgctgcgagcaggcgcggcacgcagccgggggtgagccggacgtcggggttgaggaccaggatcgcgtcgtacgccggcgaggcggcgaccgccgcgttgatcccggccgcgtatccggcgttgcgccccatctcgacgacggtcgcctcgggggccagctcgcggagcaccgcgacgctgtcgtcccgcgacgcgttgtcggcgaccgtgaggtgccatttcatcccgtccaggccggtgcgcagcccggcgatcaggtccgggagcagccgggcgctgttgtaggagacgaccgccaccagaatcgtcatcgcgacgccagcctcgccttcagtccgcgcagcaccctgccggtgcggccgctcttgagcttctcccccagcgcgccctgcttgaccgtgcgggtcagcgccgtctgcgcgcgccgcgcggtcgcgaccgcaccgcgaccggcccggccggcggcgaccggggtctcgtcgttcttcagccgggtcttgtacagcgcctcggacttgccgagatcgatcagccggatgccgtcggccgcgccggcctcggccatccgcaggcagagcagaatgccggccgagtacttcgacagctcctggtcgtaggaggggaaccagtaggcgagcacgttctcgctgcgcaggccgaggtgcgcggcgaccgggcggtccccggcgtacaccgtggagaccaccgcgcggcagccgtccgcgtccgacgcccgcaactcgtcgaggacgccctcgatccagggggtggcgaagcggtcgtactgctgggtgcgccggtactgcgccgacttccactcgcgcagcgcggccagcgccaccgggtcgcggtcgtcccagacgaaccgctcgtcgccgacctcgcgggccatcttccgctgcttgcgcagggtctgcttgaccacgtcaccggcccggttgcgatcctccacatacgccgcgtagccgtcggtgaggttcatcagcggcgacccggcgaccgccgtgtggaaccgcccgaactgcccggccatcaggtggtcatactcccagaccggcagcttgcacgccctgagcagggcagtcggatcgaagtcccacccctgccggtgtacgacgccctgacagtccgtgatgccgaacccgaccgggacgccgatcacgcggttgcgtacctcgtacgcgaagaagccggcgatcccgtcggagtcctccagcaccgcgacccgggcggtgggccgctgccgtgcgaccgcgagggtgaactccggggccaggaaggggctctgcagtccgggctggtccttctggaactggcgccacgcggccagctcgccgggtccgagttcatccgggcgtaccacggagactttcacgcgttgctcgttcctgcgaaggtggggcggccgagggcacggtattcccagccggcggcggtccagtgggccgggaccagggcgtgtcggccgtcgacgatgcggcggccgcggaccacggcggccatcgcggacggttcgatgtcgcggaactcgttccactcggtgagcagcaccacgacgtcggcgtcgcgcgcggcgtccagcgcgttcgtggcgtacgtcagctccgggtgcacccgtttcgcgttgtccatcgcagccgggtcgtagacgaccacgccggcgcccatccggtgcagggtggccgccacgtcgagggccggcgcgtcccggatgtcgtcggagttgggcttgaaggcggcgccgagcgcggcgacccgcttaccggcgacgtgcccgccgcagagttccacgaccagatcgacggtacgggcgcggcgtcggcggttgatcccgtcgatctcgcgcaggaagccgacggcctggccgacgccgagctcctcggcccggtgcgcgaacgcccggatgtccttgggcaggcagccgccgccgaaaccgaggccggggcgcaggaaccggccgccgatccgctcgtcgtaggcgagggcctcggcgaggtcgtgcacgtcggcgccggtcgcctcacacacctcggccatcgcgttgatgtaggagatcttggtggccagaaacgagttcgccgcaaccttgaccagctcggcggtctgcaggtcggtgaccttgaccggcacgtcctgggcgagcaccggctggaacgcctcgcgcagccggtcctcggcccacgcgctggtgacaccgaagaccagccggtcgggtctcatcgtgtcgtcgaccgcgaagccctcgcggaggaactccgggttccaggcgagctccacctgatcgccggccggggccagctcgcgcagcggaccggccagccgggcggcggtgccgaccgggacggtggacttgccgaccaccagggtacggcgggtcaggtgcgcggcgagcgcggtcaccgcggcgtcgacatgggtcaggtcggccgcctcggaacccgcctgctgcggggtgccgacgcagacgaagtgcacgtcaccgaaggcgccggcctcggcgaagtcggtggtgaaccgcagccggccggactcgagggccttggtgagcagctccggcagaccgggctcgaagaacgggacctcgccggccgccagccgctcgatcttgcgggagtcgacgtcgacgccgagcacctcgaagcccatcaccgccatgcagatcgcgtgggtggcgccgaggtacccggtcccgatgacggtgagacggggacgtgcggtcatcagtaggctcccgagctgcgcacgacggcgctgacggtgcggaacagaatggccaggtccatggcgagcgaccagttctccacatagctgaggtcgagccggatcgactcctcccaggacaggtcggagcggccggagacctgccacaggccggtcaggccgggtttgacgacgagccggcgcagcatgtccgccgggtagccggccacctcggcggccagcggcgggcgcggtccgaccagcgacatgtcacccttcaccacgttcagcagctggggcagttcgtccaccgagaagcggcgcagccactggccgatcggggtgacccgcggatcgttgcggatcttgaagagttcgccgtcgtgctcgttgagctccttgagctcggccagccgcgcctcggcgtcgaccaccatggtgcggaacttgtacagcatgaaggtgcggccgtccttgccgacccgctcctgtttgaagatcaccggcccgcggccgccccggccccaccggaccagcgcggagaccaccaggaggatcggcgagagcaggccgagcagcgcgatcgcgccgacccggtcgaaggtggccttgaggaaccgggcgctgcccttgagcttggggtgctcgacgtgcagcatcggcaggccgtccaccgggcggatggtggtccggtcgccggccacgtcgaccagggtgctggccacgatcaggtcgatctcgtcgcgttccagctgccaggcgagccggcgcagggccgggccgtcgatctccgggcaggccagcacgatgacggtgtccgcgtcggcccgggtgaccgccgagtcgaccgcgtcgaaggtgccgtagaccggcggcatgcccttggcgaacgtcttcggggtcggggtggccggcagcaccgcgccgatcacgccgagcccgtggtaccgctcgcggcgcaaccggcgggtcatgtcggagaccgccttctcgtggccgaccagcagcacccggtgcagccggttgccgcggccccaggagcggtgcaggcgctgccggtacaggtagcgggcgcccaggtcgacgacgatcgccagcggcagcgcgatgctcacgtagccgcgggccagccgcaggtcgaaggcgaacgagacgatggccagcgcggcggtcagggccagcccggcccggaacacccgggcgtactcgtcggtgccgacgaacaggtggcgcggctcgtacgcccggttcgccgacaggcagacgatccaggcgatcggcagcagggccgtcagcaggacgtagcccttcatgttcggctccgacccgtccgggccgaagcgcaggacgagcgcccagcacgcggcgcccagcccgacgacatagtcgatgaggtacagcatccgggcgtaccggttctgccagcccgcccgcgtctcgccggcccgtttaccccgccggacctgcgaagcgcgttcgctcaggtcgacggtggccagcgattcgattgtctgcacgcctctgcccccattggctgcggtcaatccattatcgaaagttaagtggcaaaccggacaatccggatgcttcaggcgccggagcgtggaccacgctcagcagtgaccggcgggtcacacgttgcaaacccaccggacacatgagacagacttccgaaccgtacccggtccgcgctacacccttccgtccgacgcgaatggcgtttcggctgagggccaatgcggacctgtccggattcccggatgcggttactacgagtatcgaaaaaggtcaatcacacacgccggactattcactgtcgtcatcgcgacgcattgtttcgacgtagtcacggcatgtgtcataccgtggcagcagcccggccgcaagggcctcggacagcgacggcgcggccgcgtccttcggcgacagcagcggcgtcccggccggccaggcgatgcccagctcgggatcgagcgggtggacgccgtgctcgtgccccggccggtaggtggccgagcagaggtaggcgaccacggcgccctcggtcagcgcgcagaacgcgtgcccgagaccctcggccagatagaccgcgcgccggtcggtgtcgtccagggtcaccgcctcccaccgcccgaaggtcggcgagccggcccggacgtccaccaccacatcgaggaccgcgccggacacacacgtcacatacttcgcctggcccggtggcacgtcggcgaaatgcaccccgcgcaccaccccccgggccgaggtggacaggttcgcctgggccaggtccagccgatgcccgaccgccgcgctcagatggtcgaagcggtaccactccaggaaggtgccgcgatcgtcgccgaaccgggccggcgtgacctcccaggcaccctcgatgctcaacggccggaccttcaccggaccaccccttccagcagccgctccaggtagacgccgtacccgctcttgagcagcggccgggccagctcccgcagctcgtcgtcggagatgaacccgaggtgccaggcggcctcctcgacacagccgatcttcaggccctgacgctcctcgatcacccgcacgtactccgaggcctgcaccatcgactggaaggtgccggtgtccagccacacggtgccgcggtcgagcacggtcacgtcgagccggccgcggcgccggtactcctcgttgaccgcggtgatctccagctcgccccggtcgctgggctccagccgggcggcgatctccaccacgtcgctgtcgtagaagtagaggcccggaacgacgtacgtcgacttcggcttctccggcttctcctcgatcgacagcacccggccgtcctcgtcgaactcgacgacgccgtagcggtgcgggtcggcgaccgggtaggcgaagatccgcccacccgccggccggccgaaccgggcgagctgccggcccaggccgacaccgtggaagatgttgtcgccgaggatcagcgcgaccggctcgtcgccgatgaagtcagcgccgatccggaacgcctgggcgatcccgtccggtttcggttgttccgcataagaaagggacagaccgaagcgattaccgtcaccgaggagacgctcgaaatggggccggtcctcgggtgtggtgatgaccaggatctcccgaattccggcggagaccagtgtggtcaacgggtagtacaccatcggtttgtcaaaaattggcatcagctgtttcgacatggccatggtgatgggccacaaccgggagccggtgccaccggccagcaggattccgcgcaccgacgaagactaaacacagtggaggcggtagtacactcggccgctgtgcagattcttgtgaccggaggcgccggtttcatcggttcggcctatgtgcgagcggtactaaaggatgaattcgcaggtgcggtcggcgcccgggtgaccgtcctggacctgttgtcctattcgggcaaccgcgcgaatctaccggtgacggattcccgactgaccttcgtgcagggcgacatcaccgacgccgatctgctgcgtgacctgcttcccgggcacgacgcggtggtccacttcgccgccgagtcgcacgtggaccggtcgatcagcggcgccgtgcccttcgtcaccaccaacgtcctcgggacccagatcctgctcgacgccgcccgatcggccggggtgggacggttcctgcacgtctcgacggacgaggtgtacgggtcgatcgacgacggatcgtggaccgagacgtggccgctggcgccgaactcgccgtacgccgcctccaaggcctcctcggacctgctggccctcgccgcgcaccggacccacgggatggacgtggtcgtcacccggtgctccaacaactacggaacacaccagttcccggagaaggtcatcccgctcttcgtgaccaacctgctggacggcaagccggtgccgctctacggcgacggcgggaacatccgggactggctgcacgtcaccgatcatgtgcgggggatccagctggccctggagaaggggcgggccggcgaggtctacaacatcggcggcgggaccgagctgagcaaccgggagctgaccgggatgctgctggaggcctgcggggccggctgggagcgggtgacccgggtggcggaccgcaaggggcacgaccgtcgctactcgctggacatcaccaagatcaaagatgaactggggtacgaaccgcaggtcaccctgcacgacggactcgccgcgacggtcgcctggtatcgggagaaccgtgcctggtgggagccgctgaaggcgaaggccgggctctgatgcggtggttgatcaccggggccggggggatgctcggccgggacctgcaggccgtgctcgacggcgcggacgtcatcgcggccacccgggccgacctcgacatcacctcgcccgaccaggtgcgcgacgcggtggccggggtcgacgtggtgatcaacgcggcggcctggaccgacgtggacggtgcggagaccgctaccgaagcggccaccgcgatcaacggccacggcgcggcccacctcgccgccgctgccggcagacgcctcatccacgtgtcgaccgactacgtcttcgacggaaccgccaccacgccgatcccggaagacgcgccgcgatccccgatcaacgcctacggccacggcaaagccatcggcgagcaggcggtcctcgccgccggcggatccgtggtccgcaccgcctggctgtacggccggcacggccccaacttcgtccgcaccatgctgcggctcgccgagacccgggacaccgtggacgtggtcgacgatcaggaaggaccaccgacctggtcgtacgccttggccacccaactggtcgcgctggcccgctccggcgccacccccggcatctaccacggcacggcggccggctcgacaacgtggttcggcctggcccgggcggccttcaccgcagccgggctggacccggcccgggtccgccccaccaccagcgcccggttcgtccgaccggcccgccgcccggcctacagcgtgctgggccacgcgggctggtccggcaccggcgtcgacccgctgccggactggcgcgacatgctcaccaccgccatgccggccctcctcaccagccgctgacccgccgcccggtcaccccctcgctccctgagtgcgtcgggtagccgcgcggcgcaccaggtggggcgtcccgtccgggagcgggatgtgacgcgcgactctgcggtgtcccggggcctctgccggagccgtttctgtcatacctaccgccgaagatggcggcatgacactcctgtgctgttcggtgttcctggccatcgtggtcacccggctgtccggcctcctggtgaccactcttctcgacaacgcgcggccaccccgggtcaggtgtcccggggtccggctgagacgccgcgttccggtcgcagcagcagggcggacagggccagtgggaccgacagcgccaccatgctcgtcacctggtgcacccgggagaaggcgtccaggtgcaaggcatgccagagcaggtgttcggcgctgaagaccagccacgccccacccgccacccgccgcagcgtcggccgccgcaccacgccgaccgaaacgacgagcagcgcaaggtagagcccaccgacgtccctgaccaggtgctcgttgtacggcccgagcgcagagacccagtgcgcccccgcccacggaaagtcccggtagaaggagaccggaaaaccggcggcccagacaccgacgaacgccgcactcatcgccagcatccccgccacaccccgatccaccaccgcaccccgtcccgccgcagcaccctgctccgccaccgccacaccccgtcccgccgccgcaccctgctccgccaccaccacaccccgtcccgccgccgcaccctgctccgccaccaccacaccccgtcccgccgccgcaccctgctccgccaccaccacactccgtcccgccgccgcaccgctgttcaccgttgaagcccgacgctcctgtcgctgctgacgctccggcaggccatcgatcgcgggccgatgctcgaatgcgggacaccgccgtccctccgcgaacccccaacttcaggcccacggccggagtcggacgctgcaggctggccgacacgccctcggtcgcgggctgccggccggccccgggggtgtgctggggacacggaccggggcgagggtgggtgatcaggcacgggattcggtgagccactggtcgaaggtctgggtgccgcgcaggccgggggtggccgggaggttgccgccggtggccatggccctaccggccttgccgggcatggtggcggtcagaacccatttgcgcgggccccgggtacgggcgaccctgcggaccaggtcggccatctgcaggggttccgggccggcgatctccggggccaggccggccggttcgccttcggctaggcggaccagttcgacggcgacctcgcgggccgcgaccggctggctcagcatggccggcaccaccgctacgggcccgccgaagcgggtcaatgattgctcggcgaactcgtggaactgcgccgcccgcaacaccgtggcgggcaccgggccgttcagggcgatctgctcctgatggagtttcgcctggtagtaaccccactcgacccggtccaccccgatgatcgacacgaggacgtggtgccgcaccccggcccgccgctcggcattcagcaggttccgggtcaccgtctcgaagaactcggtggccttcctgccgctgagcgtctgcacattcgacacgtcgaccaccacgtcgaccccgcgcagcgcgtccgtcagcccgtttccgctgaccaggtccaccccgcgcgatcgtgcgatgaccacgacctcgtgcccggcccgttccgcctccgcgaccaccagtttgcccagccagccggtcccaccggccaccgcgatccgcatcacgtccacctctctccgctgcgttcaccaggaggacagatccgggcgccgaaacgtgacagcttctgctgttactcagctcaccaccccggaaagcggcagcggcgtacgtcgaaatccctacatggccggccgtcgcggtggtgctgcggccgcgacccacccggtgagcccgcccagcgtcgttgccgacacgcggcggcagccagctgatcaggaacgctcgctggatgcggctcgcagaaccggtccacccgagaccctcgctcggcgaagccgaagcgaacgcggcccacctgcggccatcaggatcgaccggcggaggcgctggtggctgacggaccgggggccgaaggcgagtccgtactgccggcggcgaggccgggagcggggccgtactgccgggggcgaggccgggagcggggccgtactgccgggggcgaggccgggagcggggccgtactgccgggggcgggaggtccggtgggatggagggcggcgagggcggcgacggagagcaggccggccgcgcggcgtgcccatgtcgggacgatcacgccggtcgccgggacgtggaggccggaccgggtgcttcgatagccgggtggagatcacaacctggtacctggagcagaccgcacccgggccggcgacggcggccgcgccggccgtcccggtgcgggtcgagcgggccgagatcccgtcgccggagctgagccggttcctgtacaccgcggtcggcggtgactggaactggaccgaccggctggcctggacctggcagcagtggcacgaccatctggcgcggccgggcgtgcagacctgggtggcgtcggtgcgcggcaccccgtgcggctatttcgagctggacggcacccggcccggcagcgtggagatcgtctatttcgggttgctgccgagcttcaccgggcagcggatcggcggtttcctgctcgatgcggcgctggcgcgggcgtgggcgctgaatccgtcggtggcccgggtatgggtgcacacctgcagcctggacggcccggccgcgctgccgaactatcaggcgcgcgggatgagcctctaccgcaccgagacgacgaccgtgccggtgccggcggagccgcccgggccgtggccgggcgcccaccgcgaaaccgcagcgaaatagcagaaaaatccctgtacgcggagcagtatccgttatgtgagtgaggaggtggtgtaccggagtgaccggaccagggtcgtccggcggcactcccccgcgctgatcgccaagcaggccaccggcccgggcgcgcaccgccgcaccgaacacgagcgcgccgtgctgacccgactcgccggcctgcccggggtcccccggctcgccgccgggcagcagcgccagaccctgatgctgatcgacgacggcggcgccccgcccccgcccggcccgatgccggtccccgagctggtcgacatcgcgatcgcgctggccggcacgctcgccgcggtgcaccgggccggcgtcctgcaccgtgacatcaccccggccaacgtgatgctgacccgcggccggccggtgctgatcgactacgacctggcgctgaccggcccgccggagccggacgaggccccggtcggcacactcggcttcctgcctccggagcagaccggccggaccgcgctgccgatcgaccgacgggccgatctctacggtctgggcgccaccctgtacaccctggcgaccggcgccccgccgttcccgaccggcgatccgctcgccctgatccacgacaccctgatccggatcccggggccgcccgggctccccggccggctggacgcgatcctgctgcggctgctggccaaggacccggacgaccggtaccagagcgccgaggggctggcccacgacctggcccggttccgcgacgacccaaacggtcggtgggtgctcggcgaccgcgacttcccggcggtgctgtgcgccccggaggcgccgctgggccgggccgcggagatcggcgagctggccgccgcgctggaccggtcgagcgccgaaccgacaccggcggtgctgatcagcggccccgccgggatcggcaagagcgcgctgatccacaccctgcgcccgctgatcaccgcgcgcggcggctggttcgtgtcgggtcgctacgagcagtcgcggaccggcacggacaccggcggcatcgcccggatggtgcgcagtctgggccggatgctgctggccgagccggagtgggagctgaccgaggaccgccggcggatcctggccgcgctcggcccgaacgcctccgcgctggccgcggtggtcccggagatggcggcgttgctgcgcgtcgatgggctgccgtaccagggtgatccgctcaccacggcggcccggctggccaccacgatcgccggcctgctgcgtgcggtcgcggtccgccgccggctggtggtgctgatcgacgatctgcagtgggcgtctgcctcgtcgctgcggatcctggacggggtcctcgccgacgggccggtcgccgggctgctgatggtcgccgcctaccgcgacgagcaggcgggcgatgacgatccgctgggcgtgatggtgacgcgctggcagcgggacgggctggccggggcgccgctgcggctggacgggctggaccgggccggtcgggcggcgctgaccgggacgttgctgcggctgccgccggacgacgcgaccgagctggcggagctgctggccggggcggggggcggcaacccgtacgcgatcgtcgaattgctcaacgcgctgcgcgcggagaatctgctgacgccggccgcggccggctggcactacgacccggccgaggtccgctcgttcgtcgcgcgccatcggctgccgcaattgttggcggtacgcctgcgtcagcagcccgagtccacccgcctgctgctgaccgcgctcacctgcctgggcgccgacgtcaccgcggacctgctggccacggccaccggcatcccgccggagagtctgccggcccgcctcgccccggccgcggcggacgggctgatcgacgccgatgacccgatccggttccgccacgacctgctcctgcagaccgcccgggagctgctgccgccggccgcgcgggagcagctgcagctggccatggcgcgccggctggccggccgggcggagttcacccggcaggccgccgagcagtatctggcggtggccggcgcgatcaccggtgacgacgagcgccggtcggcggccgcactgctgcaccgggccgggcggcgcaccgcccggatcgccaaccacctggtggccgaggagctgttcgcggccgcggaccggctgctcgcaccgctgtccgggcggggcgaccgggcggcccgggacgcgctcgcgatcgaccggcacgcggcgctgtactacctggggcggcacgccgaggcggacgtgttctaccgggagctgaccgtccgctgccgggatccgctgccgctggccggggcgaccgccgtgcagatcaacgcgctgacccagcgcggcgagtgccgggccgccctcgccctcggcctggacgcactgcggcgcttcggcctggtgccgcccgccgacctggtcgccgacaaccggcgcgcgatcaccgagctgcgcgaccggatcgcggcgcacggcccggactacccggacaccgaggtgaccgacccgcggaccgtggcgatcgccgggatcgtggagcggatgctcctcccggcgttcctgatcgacccggaccggcacgcgtggctggtgctgcaggtgcacaccctgtggcaggagaacggggtgtgcgccgcactggccggggcggccggctcggtgagctgcctgacgatcgccatgctcgacgactaccggaccggcttcgtgctgaccgagcacgccctcaacgtcgcccggaaacaccagtatcagcaggaaagcgcgatcgcggcgcatctgcacctgatgatctcggcgcactggttcctgccgctggaggagctggtcgcgccggcccggcagacccgcctggatctgctggcggccggcgacgtgcagatggccggcgtgcaatgggcgcggttgctcagcctgctgttcgagaccgaggagtcactggacgcctcgggcgacgaggcggaggcggtgctggccttcgccgaccgcaccggcaaccggttcgcccggctgatcgcgatcggtcaccggcagatggtccgggatctgcgcggcgacccgccgggggacgacgcggactacctcgcggagatcgccgcgttcccgaccgcgatggccacccaccaccagcggcgggcgctcaccgctctgctcaacggcgatccggcggccgtggacgagcactcggcggtggcactggcgggagccgacacgatccgcggtctgtactcctgcgccctgatccggctgtgccgctgtctgagtgacccggcggccacctcggaccgggactggctggcccggcgggccgccgacgcgccgttcaacttccggccgctgctgctgctcgccgacgcggaacgggcccgggccgcgggcgatccgggcaccgcgatccggctgttcgacgaggcgctgctcagcgtcggcggccggccgtggcagcacgcgctgctcgccgagcggtccgcccggatccacctggagcagggcctgacgcacaccgggcgccggctgctcgccgaggcgtgcgacgcctaccggacgtggggcgccggcgggccggtcgcccgcctggaggccgaacacccgttcctacgcgggacccgttccgacggttccagcagcggtaccggcgccgaccggatcgatctgatggcgatcctgcgcgcctcccgggcgctgagctcgcagaccacggtgaccgggctggccgccgaggtcgccggggtgctcagcgcgatgaccggggccaccgacgtgcgcctgtcgctgcgcgaccggaccctgtccgggacggccgacaccgatctgccgctgtccgcggtccgctacgtgcggcgcacccggcagccgctgctggtcgccgacgccacccgcgacgaccggttcgccggcgacgcatacctgaccggcttgaccgcgtgcagcctgctggtgctgccggtcagctgccaccgcgccgaggacgcggtgctggtgctggccaaccgacgccagcgcggggtgttcgccaccggccgcctggagacggtcgagctgatcgccgggcagctcgccgtctcgctggacaacgcactggtgcacgactcgctggagagcgaggtgcgggcgcgaaccgccgagctcgccgaccgcaaccgtgacctggaagcggccaaccagctcaaggccgacctgatcgggatgctcggccacgagatcaacaatccgctcgccaccatcctcggctatctcgatctggtgctcaccggggacgacccgctgcccgacccggtggtcggcctgctcacccgcacgcacgccaccacccggcggctgaccggcatcgtcgaggaggtgctggcgctggtcagcatcgacgccgggcggctcaccgcggtaccccgcccggtccgggtggcgccgcacatccaggccgcgctcggcgtcgcgccggcgagcgtggactgcccggcggatctgacggcggcggcccagcccgggcacctcgaccagatcctcaccaatctggtcagcaacgcgaccaagtacggcggcggggtgaccgggatcgtcgcccggggcggccgcgacgaggtcaccatcgaggtccgcgaccagggtccgggtgtcccgccggagttccgggaccggctgttcgcccggttcgcccgcgccgaccggaccgcgggccaggtcgccgggaccgggttgggcctctacatcgtccgcgagctggcccgcgccaacggcggcgacgtccgctaccgccccggcagggtcggcggctcgcgcttcatcgtcaccctcccgccggccacgcgggaggcgcagccggacatgaggtgaccgtcacccgcggcgggcagttccgtcagcggttcgcggtcgccttccgcggcgttccggccaggccgggcagcagatcgaaacagccggcggcgcgccgaaaccgaccggtggagggtcggaaccgacggtgagcgggccgagaaccgaccgctggacgggtcgaaaccggccggtgacgccgaccgcgactccgccgatcccgaagtcccgacgacagactcttcccgccaccgcgggcctcgttcgacgccgccttcagcagcaagggcattgccggcgaggggggtggtcgttgaggagggcaacaccgcgtttacctggtggctatatgcccgctagtatcccgttatgtcagggtacatccttcgcggcgtcgcgtttccgttcccgggtgggcgctttcccgagcggctcggcgccgtcgttcagcgcaccgttctcaccggtgaggagccggcccgcgtcgtgatccacgacgaggagaacgactggctggtcggcgacggggtcaacgatccggatctgcccggcgccagcgtgatcgcctgcatcgccaccatcgccgacaccgatccgggcctcgccgagctggccaccctgccggtgggccggatcgcccgccgggacgaggccggcaagccgtggaccgtcgatccgcacacctggcccgacgatctctgagaaccggttcgcccccgggcggctcctcatccggccgaccggggtgccgaccgtgctgggcgtggaactcgccgcgtacacctccgcctggtacgtccgccatccggacggcgccctgagcgcgaagcgatcggacgcccccgcccccgcaccggccgagccggcggaatccgtcgcgggcagggccgccgcggctgcggcccccgagcgggccggcggcaggaaggtgctggtcgcagggccggaatagtcttcgcattcctccccggattccgctccagggaccgatcatggggtggagggggtgcgccatgcgctggtacgtcgtcgcggtgatggtgctcgccacggcctccggctgcagcagtgcggacgagacgaccgtcgagcagaaggatcggggcaccatcgggatcgccatgccgaccaccaagtcgatccgctgggtcggggacggcaagaacatcgcccagcagttccaggtgctcggctacaagaccgacctgcagtacgccgaggatgacatcgacaaacagatcagccagatcaaggcgatgctcgccgccggggagaaggccctggtggtcggtgcgatcgacggcaccgcgctgaaggacgtgctggccgccgcggcgaccgcgaaggttccggtgatctcctacgaccggctgatccgggacaccccgaacatcacctactacgccaccttcgacaacttccgggtcggcatcctgcaggggacgacgatcgtgaaggcactccacctggcgggttcgggcggcagccacaccatcgagctgttcgccgggtcggcggacgacaacaacgccacgttcttcttcaacggggcgatgagcgtgctccagccgtacctaaagtccggccggctgcgggtggtctccggtgagacctcgttccagcaggtcgcgacccagcgctgggacaacgcggtggccaagaagcggatgcagcggctgctcgccggcccgctgcgcggcacccgggtggacgcggtgctcgccccgaacgacggcctggcccggggcatcctcgaagccgtccaggaggccgggtacgccaaaccaccggtggtcacggggcaggacgcggaactcgactcggtcaaactgatcgccgccggcaaacagaccgagaccgtctacaaggacacccgggagttggccaaggtggccgtgcagatgaccaactcgctgctgctgggcggagtgcccgtggtcaacgacgagaaacagtacgacaacggtgtcaaggtggtcccgacgttcctgctgcagccggtgaacgtggaccgctccaactacaagcgggtgctggtcgacggcgggtactacaccgccgaccagctggcggggtgagctcgatgatccagcgcttcctcgacctgtcggtccggaccaaattgaccatcctggtcgccgccagcatcctggccctggccgtctgcctggtggtgaccacgatcaacggtcgtaccgccgacagcaccgcccgcgacctggagaacctgaacacggccagcgcgatggtgctgcagctcgaccgggaggccagcgagctgcgcgccaacggcatccagtcgatcgtccgcagcgacccggccaagcagagcgagctgctgaaggcccggatctccgaggtcgacgacctgctgaccaggctgcaggcgatcgacctgcccagcgggctggacgcggcggtcggccggatcaaggcggtcaccgacgactacaccatcacgctgaagcgcttcgtcgacgcggccgccgtcgaccaggccggcgcccggctcgcctgggagcaggtcgacgtcgacaactacctgatcagcgcggtgctggcgaacgagcgggcgctgttcctggacaccgtggcccgggccaaccagaacgccgcgcagagccgggccaccgccaaccacatcctgtggctggccgtcgcgatcgccgcgatcctggtctgcgtgctggcccggctggtcgtcctgtcgatcacccggccgctgcagcgggtccgcggcgcgctgcaggcgatggccgacggcgacctgaccgtcgccgccgaggtccgcggccaggacgaggtcggccagatggcccgcgccctggacgaggcgcaggccaacacccggcgggtggtgtcctcggtggccggctcggcgcaggccgtcgcggccgccgccgagcagctcaccgcgaccgcgagcaccatgtcccggtccgccgaccaggccgcctcgcaggcacagaccgcgtcgcaggccgccgagggcgtcaacgacaacgtcagcagcgtcgcgcagggcacccaccagatgggcgactcgatccgggacatcgcgcacaacgcgaccgaggccgcccgggtggccgagcaggcggtggcggtcgccgacgcgaccaccacccaggtcggcaagctgggcgagtcgtcccgcgagatcgccgaggtgatcaaagtgatcaccagcatcgccgagcagaccaacctgctcgcgctgaacgccaccatcgaggcggcccgggccggcgaactcggcaagggtttcgccgtggtcgccggcgaggtgaaggaactcgcccaggagaccgcccgggccaccgacgacatctcccgccgggtccaggccatccaggccgacacggccggagcggtcaccgcgatcggcgagatcacctcggtcatcgccagcatcaacgactaccaggccacgatcgccgcggcggtcgcccagcagaccgccaccaccgagcagatgagccacaacgtggccctggccgcttccggtgccggcgacatcgccgccaacatcaccggcctggcgaccgccacccaggtcagcaccgagggcatcgcgcagtcccagcaggcggtgaccgagctcagccagatggccaacaacctgcagaccctggtcagccacttccgctactgacgcctcacccgtggatcatcagccaggcgccgacggtgaagaagtcggcgtcggtgaggccgcggttgccgtccacccggtgcagcagggcccggcccggatggtgcgcggccacccagcggcgatcgttgtcggtcagctcgtcgtcgatccagacgaagctgcggccggccgcccaggtcaccaggaacgccgtcttccagtgcaggccgggcagcggcgcctcgtccggccagtcgacgaccgggagcgggggcaggccgagccgcggggcgaccacctcgttcgcctcgtccatccaggtggtggcccagaccaggtcggccgggagtttccgcagccgccgcccgtcctccgggtcgatccggtgcagcagcggattgccgccgtccggagccggtggggcggcgccgacggtccgggcgcggaacgggatcagcggcccgtccacgtcgagaaacaccagcggtcggcccagcaccgccgcaccctacctggccgctgcggttcgcggtcaatgatcggcggtacgccggtgccggacccgtctcgtcccgtcgccgcgccgcgcgccgggtccggcgcccgccggtgcggtcaggggcggaccagggtgagcaggcgctggccccaccagacggcgaccgcgatgccgatgccgacgccgaagacgccgaccgcgcggggatccgcgatgaagaagccgaagacgccgaggacgaccgcggtgatgccgcgcagcaccgtgatccggaacagcagcagcgcgacgccgacgccgatcagcgcgccgccggtgcgggtggcggccgtaccccacagtgcggccgcgggcgggaagccggcccggaccgtcagcgcgtacagcaggctgccgatgctcaggatgatggtcgcgaccagcggggattcgacgatcaccggcgggatcaaccgccgccggacgatcactgcgacggccgcggccagcagggcggcgggcagcaccggcagcaaagaccactgcagcggctcgccgaacggcgccaccaggtagaggccggccgccaccgcgtacagtgcggcgacggtcaccccgaacgcgtccgcggtgagcagcccggcggagatctgcccggcggcgtcccagcgcccgcgcagtccggcgtcgcgggccagcgccgcgccgatccacgggccggcggccaggcacagcatcagcgcgagcaccccggcgatggccagctcaccccagctcgaggcggtccgcccccgggcggtgaacacgaaatggctgaacagcgccaccgaagccgccccgggcaggatcaggcccagcacccggagcacggtcagccgggggacctcgggggccggttcgccggccggcgccgcggcgccctcggcttcggcgacaccgagcaccaccgccgccccgggcagggcggcgacccggaccggccggcccagctcgcgttccagcacccgcggcagggcgggcatcgcggcggcggcacccaccgcgtacacctccgcgatgtcgttcctgcccagctcggcggcgcgcaacgcctccgcggccagctcggggagacgccgcaggaccggttcggcggcccgttccaccagggtcgtgctgagcacgacggccgctccgggcgcgggcagcggcacggtcacggccggctgctgcgagacagcctccttgccggtacgcaacaccgccaccgtggcggccgccccgtcccgcaactagctagctagacttctgcttttaagcccagataactggcctgaatatgttaatgagagaatcggtattcctcatgtgtggcatgttttcgtctttgctcttgcattttcgctagcaattaatgtgcatcgattatcagctattgccagcgccagatataagcgatttaagctaagaaaacgcattaagatgcaaaacgataaagtgcgatcagtaattcaaaaccttacagaagagcaatctatggttttgtgcgcagcccttaatgaaggcaggaagtatgtggttacatcaaaacaattcccatacattagtgagttgattgagcttggtgtgttgaacaaaactttttcccgatggaatgggaagcatatattattccctattgaggatatttactggactgaattagttgccagctatgatccatataatattgagataaagccaaggccaatatctaagtaactagataagaggaatcgattttcccttaattttctggcgtccactgcatgttatgccgcgttcgccaggcttgctgtaccatgtgcgctgattcttgcgctcaatacgttgcaggttgctttcaatctgtttgtggtattcagccagcactgtaaggtctatcggatttagtgcgctttctactctttcggtttgcgattcagcgagagaatagggcggttaactggttttgcgcttaccccaaccaacaggggatttgctgctttccattgagcctgtttctctgcgcgacgttcgcggcggcgtgtttgtgcatccatctggattctcctgtcagttagctttggtggtgtgtggcagttgtagtcctgaacgaaaacccccctagctagctaggctttgaatgctgcccttcttcagggcttaatttttaagagcgtcaccttcatggtggtcagtgcgtcctgctgatgtgctcagtatcaccgccagtggtatttatgtcaacaccgccagagataatttatcaccgcagatggttatctgtatgttttttatatgaatttattttttgcaggggggcattgtttggtaggtgagagatctgaattgctatgtttagtgagttgtatctatttatttttcaataaatacaattggttatgtgttttgggggcgatcgtgaggcaaagaaaacccggcgctgaggccgggttattcttgttctctggtcaaattatatagttggaaaacaaggatgcatatatgaatgaacgatgcagaggcaatgccgatggcgatagtgggtatcatgtagccgcttatgctggaaagaagcaataacccgcagaaaaacaaagctccaagctcaacaaaactaagggcatagacaataactaccgatgtcatatacccatactctctaatcttggccagtcggcgcgttctgcttccgattagaaacgtcaaggcagcaatcaggattgcaatcatggttcctgcatatgatgacaatgtcgccccaagaccatctctatgagctgaaaaagaaacaccaggaatgtagtggcggaaaaggagatagcaaatgcttacgataacgtaaggaattattactatgtaaacaccaggcatgattctgttccgcataattactcctgataattaatccttaactttgcccacctgccttttaaaacattccagtatatcacttttcattcttgcgtagcaatatgccatctcttcagctatctcagcattggtgaccttgttcagaggcgctgagagatggcctttttctgatagataatgttctgttaaaatatctccggcctcatcttttgcccgcaggctaatgtctgaaaattgaggtgacgggttaaaaataatatccttggcaaccttttttatatcccttttaaattttggcttaatgactatatccaatgagtcaaaaagctccccttcaatatctgttgcccctaagacctttaatatatcgccaaatacaggtagcttggcttctaccttcaccgttgttcggccgatgaaatgcatatgcataacatcgtctttggtggttcccctcatcagtggctctatctgaacgcgctctccactgcttaatgacattcctttcccgattaaaaaatctgtcagatcggatgtggtcggcccgaaaacagttctggcaaaaccaatggtgtcgccttcaacaaacaaaaaagatgggaatcccaatgattcgtcatctgcgaggctgttcttaatatcttcaactgaagctttagagcgatttatcttctgaaccagactcttgtcatttgttttggtaaagagaaaagtttttccatcgattttatgaatatacaaataattggagccaacctgcaggtgatgattatcagccagcagagaattaaggaaaacagacaggtttattgagcgcttatctttccctttatttttgctgcggtaagtcgcataaaaaccattcttcataattcaatccatttactatgttatgttctgaggggagtgaaaattcccctaattcgatgaagattcttgctcaattgttatcagctatgcgccgaccagaacaccttgccgatcagccaaacgtctcttcaggccactgactagcgataactttccccacaacggaacaactctcattgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattcgtcaggaaagcttctagctagctagctcacttctaagtgacggctgcatactaaccgcttcatacatctcgtagatttctctggcgattgaagggctaaattcttcaacgctaactttgagaatttttgtaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcatacgttaaatctatcaccgcaagggataaatatctaacaccgtgcgtgttgactattttacctctggcggtgataatggttgcatgtactaaggaggttgtatggaacaacgcataaccctgaaagattatgcaatgcgctttgggcaaaccaagacagctaaagatctgaccaagcgacagtttaaagtgctgcttgccattctgcgtaaaacctatgggtggaataaaccaatggacagaatcaccgattctcaacttagcgagattacaaagttacctgtcaaacggtgcaatgaagccaagttagaactcgtcagaatgaatattatcaagcagcaaggcggcatgtttggaccaaataaaaacatctcagaatggtgcatccctcaaaacgagggaaaatcccctaaaacgagggataaaacatccctcaaattgggggattgctatccctcaaaacagggggacacaaaagacactattacaaaagaaaaaagaaaagattattcgtcagagaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtctagctagctagatccccagcccggccggcatcgcggccgccaccagcagcggatacgccccgagcgcggcccgccggaccgcggcccgggacaggccctgggcgcgcaacgcggccagatcctcggcctgccggtcccggccggccgcggcggtcagcaccagcaccccggccgccagcatcgcgaccagcaccccgaccagggcggcatagccgagcgcgacggccgcgccctgctgatccaggcgggcggcgacctgggcggcccgcaggtcaccggtcaccacgatcccctgcccggccagccggtccagcacgtcagccggcgcccgggcattcagccacacctcgccggacgcggtcgggccggcatcggtggagacccgatccaggtattccagatcggtcagcacggcgggctcaccgaacgccggcacggccgccagccggcccgccacggtcaccgggacctgccgatagtccaggccggtcgcccggcccgggacgaaactgccggtcgccaggaccggcagcggccacggggtgtccgccggctgcagcagcagcccgtcgctcgcctcgtccatcgtggtcacctcgagccgcaacccgtccggcacggtgccgagccggccgccctgcccgacccgccacgccgccggatcaccgctgcccagcccgtgcagggtgagcacaccgtgcacgccgagcgtggtgccggccgcgatccgcagcgcgttcaaccggcagccgccggcacactgatcggtcgcgtagtggtagacgtgccgacccggccgcagcacccccatcggtgccagcacgtccgagcccggcccgcggaccgggctgaccaccgcgtccacgctgaccgcccggccctcggcgaactccgcggcggtgatgtccagggtcagatccggcccgcccggcacctcgaccggggcgggcgcgggcgggtgcagcacggcggcgaccccggccggcacggaaccgcccggccagtgggcgaccgcgcccagccggtcgctgtccaccgcgagcagcggcggctcccccggatgctgggtgaccttgaccgccgccatcgcgaacgaccggtccgggtccaccgcacggaccgccgcgagcagccgggcacgcccgatcgggccggccgcgagcacacggtcggcgcccacgctcaggtcggcctcgacccggcggccgcgggccgccacatcggcggcggccaccacgtagcagctgaccgcgaccgcggcgaccagcagtgcgaacacccgcccggtggcggcccggcgggccagcagcaggccggtcagcccggggccgagccgtccccgccgcagagcccgtcgcccgagccgggcggcgaccggccgcagcagccgggccaccagcagcgcaccggccagcatggacagtgccggtgcggtcgcgccgacaccgaccaggtcaccccggccgagcgcgagctggacgacggcggccacggccagcccgaggaccagcacgtcgacggcgagcccggcccggcggcccggaaccggggtccggcgcagcagctcaccgaccggacggcgcagcggacccagctgggcgatcagcacggtcagcacggccgcggcggaggccggcgcggcataccgcagcgagctcaggtgcaccccggcacccacc
